US009388394B2

(12) United States Patent
Heinrichs et al.

(10) Patent No.: US 9,388,394 B2
(45) Date of Patent: Jul. 12, 2016

(54) VACCINES AGAINST CLOSTRIDIUM DIFFICILE COMPRISING RECOMBINANT TOXINS

(71) Applicant: Merck Sharp & Dohme Corp., Rahway, NJ (US)

(72) Inventors: Jon Henry Heinrichs, Doylestown, PA (US); Jean-Luc Bodmer, Concord, MA (US); Susan Lynn Secore, Telford, PA (US); Aaron Rudy Goerke, Danville, CA (US); Ivette Caro-Aguilar, Schwenksville, PA (US); Melanie S. Horton, Ambler, PA (US); Matthew Ryan Miezeiewski, Phoenixville, PA (US); Julie M. Skinner, Schwenskville, PA (US); Su Wang, Schwenksville, PA (US); Jinfu Xie, Haverford, PA (US); Rachel Flora Xoconostle, Collegeville, PA (US); Julie K. Zorman, Quakertown, PA (US)

(73) Assignee: Merck Sharp & Dohme Corp., Rahway, NJ (US)

( * ) Notice: Subject to any disclaimer, the term of this patent is extended or adjusted under 35 U.S.C. 154(b) by 0 days.

(21) Appl. No.: 14/374,792

(22) PCT Filed: Jan. 25, 2013

(86) PCT No.: PCT/US2013/023189
§ 371 (c)(1),
(2) Date: Jul. 25, 2014

(87) PCT Pub. No.: WO2013/112867
PCT Pub. Date: Aug. 1, 2013

(65) Prior Publication Data
US 2015/0044250 A1 Feb. 12, 2015

Related U.S. Application Data

(60) Provisional application No. 61/591,631, filed on Jan. 27, 2012, provisional application No. 61/596,419, filed on Feb. 8, 2012, provisional application No. 61/703,754, filed on Sep. 20, 2012.

(51) Int. Cl.
| C07K 1/00 | (2006.01) |
| C12N 9/10 | (2006.01) |
| C07K 14/33 | (2006.01) |
| A61K 39/08 | (2006.01) |
| C12N 9/52 | (2006.01) |
| A61K 39/00 | (2006.01) |
| A61K 38/00 | (2006.01) |

(52) U.S. Cl.
CPC .............. *C12N 9/1051* (2013.01); *A61K 39/08* (2013.01); *C07K 14/33* (2013.01); *C12N 9/1077* (2013.01); *C12N 9/52* (2013.01); *A61K 38/00* (2013.01); *A61K 2039/55505* (2013.01); *A61K 2039/55577* (2013.01)

(58) Field of Classification Search
CPC ..................................................... C12N 9/1051
See application file for complete search history.

(56) References Cited

U.S. PATENT DOCUMENTS

| 6,573,003 B2 | 6/2003 | Williams et al. |
| 7,226,597 B2 | 6/2007 | Ballard et al. |
| 2011/0053244 A1 | 3/2011 | Oyler et al. |
| 2012/0269841 A1 | 10/2012 | Sidhu et al. |

FOREIGN PATENT DOCUMENTS

| WO | WO9859053 | 12/1998 |
| WO | WO9920304 | 4/1999 |
| WO | WO0061761 | 10/2000 |
| WO | WO2005058353 | 7/2005 |
| WO | WO2010093801 A1 | 8/2010 |
| WO | WO2011060431 | 5/2011 |
| WO | WO2011068953 | 6/2011 |
| WO | WO2012028741 | 3/2012 |

OTHER PUBLICATIONS

Aslam et al., Seeking a safer blood supply., Lancet, 2005, 1464, 365(9469).
Bacci et al., Binary Toxin and Death after Clostridium difficile Infection, Emerg. Infect. Dis., 2011, 976-982, 17(6).
Barroso et al., Mutagenesis of the Clostridium difficile toxin B gene and effect on cytotoxic activity, Microbial Pathogenesis, 1994, 297-303, 16.
Barth et al., Binary Bacterial Toxins: Biochemistry, Biology, and Applications of Common Clostridium and Bacillus Proteins, Microbiology and Molecular Biology Reviews, 2004, 373-402, 68(3).

(Continued)

*Primary Examiner* — Albert Navarro
(74) *Attorney, Agent, or Firm* — Gloria Fuentes; Henry P. Wu

(57) ABSTRACT

The present invention relates to recombinant *C. difficile* toxin A (TcdA) and toxin B (TcdB) and binary toxin A (CDTa) proteins comprising specifically defined mutations relative to the native toxin sequence that substantially reduce or eliminate toxicity. The invention also relates to vaccines and immunogenic compositions comprising these recombinant toxins, as well as combinations of these toxins with binary toxin B (CDTb), which are capable of providing protection against *C. difficile* infection and/or the effects thereof. The invention also relates to methods of inducing an immune response to *C. difficile* comprising administering the vaccines and immunogenic compositions described herein to a patient. The invention also encompasses methods of expressing recombinant *C. difficile* toxin A and toxin B and CDTa mutants and CDTb in recombinant expression systems. In exemplary embodiments, TcdA, TcdB, and CDTa mutant toxins comprising sufficient mutations to substantially reduce or eliminate toxicity are expressed in the baculovirus/insect cell expression system.

7 Claims, 29 Drawing Sheets

(56) References Cited

OTHER PUBLICATIONS

Bartlett et al., The Case for Vancomycin as the Preferred Drug for Treatment of Clostridium difficile Infection, Clinical Infectious Diseases, 2008, 1489-92, 46(10).

Bauer et al., Clostridium difficile infection in Europe: a hospital-based survey, Lancet, 2011, 6373, 377(9759).

Busch et al., A Common Motif of Eukaryotic Glycosyltransferases Is Essential for the Enzyme Activity of Large Clostridial Cytotoxins, The Journal of Biological Chemistry, 1998, 19566-19572, 273(31).

Busch et al., Involvement of a Conserved Tryptophan Residue in the UDP-Glucose Binding of Large Clostridial Cytotoxin Glycosyltransferases, The Journal of Biological Chemistry, 2000, 13228-13234, 275(18).

Dupont et al., New advances in Clostridium difficile infection: changing epidemiology, diagnosis, treatment and control, Current Opinion in Infectious Diseases, 2008, 500-507, 21.

Fernie et al., Active and passive immunization to protect against antibiotic associated caecitis in hamsters., Devel. Biol. Standard, 1983, 325-332, 53.

Gardiner et al., A DNA vaccine targeting the receptor-binding domain of Clostridium difficile toxin A, Vaccine, 2009; 3598-3604, 27.

Gerding et al., Advances in pathogenesis, diagnosis and management of CDI, Nature Reviews—Gastroenterology & Hepatology, 2011, 67-68, 8(2).

Gerhard et al., Comparison of wild type with recombinant Clostridium difficile toxin A, Microbial Pathogenesis, 2005, 77-83, 38.

Gerhard et al., Glucosylation of Rho GTPases by Clostridium difficile toxin A triggers apoptosis in intestinal epithelial cells, Journal of Medical Microbiology, 2008, 765-170, 57.

Geric et al., Binary Toxin—Producing, Large Clostridial Toxin—Negative Clostridium difficile Strains Are Enterotoxic but Do Not Cause Disease in Hamsters, Journal of Infectious Diseases, 2006, 1143-1150, 193(8).

Ghose et al., Transcutaneous Immunization with Clostridium difficile Toxoid A Induces Systemic and Mucosal Immune Responses and Toxin A—Neutralizing Antibodies in Mice, Infection and Immunity, 2007, 2826-2832, 75(6).

Goldenberg et al., Lack of association of tcdC type and binary toxin status with disease severity and outcome in toxigenic Clostridium difficile, Journal of Infection, 2011, 355-362, 62.

Gorbach, S.L., Antibiotics and Clostridium Difficile, The New England Journal of Medicine, 1999, 1690-1691, 341(22).

Gulke et al., Characterization of the Enzymatic Component of the ADPRibosyltransferase Toxin CDTa from Clostridium difficile, Infection and Immunity, 2001, 6004-6011, 69(10).

Jank et al., Change of the Donor Substrate Specificity of Clostridium difficile Toxin B by Site-directed Mutagenesis, Journal of Biological Chemistry, 2005, 37833-37838, 280.

Jank et al., Clostridium difficile Glucosyltransferase Toxin B-essential Amino Acids for Substrate Binding, The Journal of Biological Chemistry, 2007, 35222-35231, 282(48).

Karlstrom, A Prospective Nationwide Study of Clostridium difficile—Associated Diarrhea in Sweden, Clinical Infectious Diseases, 1998, 141-145, 26(1).

Kelly et al., Clostridium Difficile Colitis, The New England Journal of Medicine, 1994, 257-262, 330(4).

Kim et al., Immunization of Adult Hamsters against Clostridium diffcile—Associated Ileocecitis and Transfer of Protection to Infant Hamsters, Infection and Immunity, 1987, 2984-2992, 55(12).

Kyne et al., Community-acquired Clostridium difficile infection, Journal of Infection, 1998, 287-288, 36.

Lambert et al., Population-Based Surveillance of Clostridium difficile Infection in Manitoba, Canada, by Using Interim Surveillance Definitions, infection control and hospital epidemiology, 2009, 945-951, 30(10).

Libby et al., Effects of the Two Toxins of Clostridium difficile in Antibiotic-Associated Cecitis in Hamsters, Infection and Immunity, 1982, 822-629, 36(2).

Loo et al., Host and Pathogen Factors for Clostridium difficile Infection and Colonization, New England Journal of Medicine, 2006, 1693-1703, 365(18).

Lyerly et al., Vaccination against Lethal Clostridium difficile Enterocolitis with a Nontoxic Recombinant Peptide of Toxin A, Current Microbiology, 1990, 29-32, 21.

McDonald et al., An Epidemic, Toxin Gene—Variant Strain of Clostridium difficile, New England Journal of Medicine, 2005, 2433-2441, 353(23).

MMWR, Surveillance for Community-Associated Clostridium difficile, 57(13), 340-343, 2008.

Muto, Why Are Antibiotic-Resistant Nosocomial Infections Spiraling Out of Control?, Infection Control and Hospital Epidemiology, 2005, 10-12, 26(1).

Nagahama et al., Characterization of the Enzymatic Comportent of Clostridium perfringeris Iota-Toxin, Journal of Bacteriology, 2000, 2096-2103, 182(8).

Noren et al., Molecular Epidemiology of Hospital-Associated and Community-Acquired Clostridium difficile, Journal of Clinical Microbiology, 2004, 3635-3643, 42(8).

Paltansing et al., Characteristics and incidence of Clostridium difficile-associated disease in The Netherlands, 2005, Clinical Microbiology and Infectious Diseases, 2007, 1058-64, 13(11).

Pepin et al., Clostridium difficile-associated diarrhea in a region of Quebec from 1991 to 2003: a changing pattern of disease severity, CMAJ, 2004, 466-72, 171(5).

Perelle et al., Evidence that Arg-295, Glu-378, and Glu-380 are active-site residues of the ADP-ribosyltransferase activity of iota toxin, FEBS, 1996, 191-194, 395.

Perelle et al., Production of a Complete Binary Toxin (Actin Specific ADPRibosyltransferase) by Clostridium difficile CD196, Infection and Immunity, 1997, 1402-1407, 65(4).

Prochazkova et al., Structural and Molecular Mechanism for Autoprocessing of MARTX Toxin of Vibrio cholerae at Multiple Sites, The Journal of Biological Chemistry, 2009, 26557-26568, 284(39).

Pruitt et al., Structural Determinants of Clostridium difficile Toxin A Glucosyltransferase Activity, Journal of Biological Chemistry, 2012, 8013-8020, 287.

Pruitt et al., Structural organization of the functional domains Clostridium difficile toxins A and B, PNAS, 2010, 13467-13472, 107(30).

Pruitt et al., Structure-Function Analysis of Inositol Hexakisphosphate-induced Autoprocessing in Clostridium difficile ToxinA, The Journal of Biological Chemistry, 2009, 21934-21940, 284(33).

Reinert et al., Structural Basis for the Function of Clostridium difficile Toxin B, Journal of Molecular Biology, 2005, 973-981, 351.

Schirmer et al., Large clostridial cytotoxins: cellular biology of Rho/Ras-glucosylating toxins, Biochimica et Biophysica Acta, 2004, 66-74, 1673.

Schwan et al., Clostridium difficile Toxin CDT Induces Formation of Microtubule-Based Protrusions and Increases Adherence of Bacteria, PLOS Pathogens, 2009, e1000626, 5(10).

Sheahan et al., Autoprocessing of the Vibrio cholerae RTX toxin by the cysteine protease main, The EMBO Journal, 2007, 2552-2561, 26.

Spyres et al., Mutational Analysis of the Enzymatic Domain of Clostridium difficile Toxin B Reveals Novel Inhibitors of the Wild-Type Toxin, Infection and Immunity, 2003, 3294-3301, 71(6).

Sundriyal et al., Expression, purification and cell cytotoxicity of actin-modifying binary toxin from Clostridium difficile, Protein Expression and Purification, 2010, 42-48, 74.

Sundriyal et al., Structural Basis for Substrate Recognition in the Enzymatic Component of ADP-ribosyltransferase Toxin CDTa from Clostridium difficile, The Journal of Biological Chemistry, 2009; 28713-28719, 284(42).

Teichert et al., Application of Mutated Clostridium difficile Toxin A for Determination of Glucosyltransferase-Dependent Effects, Infection and Immunity, 2006, 6006-6010, 74(10).

(56) References Cited

OTHER PUBLICATIONS

Torres et al., Evaluation of Formalin-Inactivated Clostridium difficile Vaccines Administered by Parenteral and Mucosal Routes of Immunization in Hamsters, Infection and Immunity, 1995, 4619-4627, 63(12).

Tsuge et al., Crystal Structure and Site-directed Mutagenesis of Enzymatic Components from Clostridium perfringens Iota-toxin, Journal of Molecular Biology, 2003, 471-483, 325.

Tsuge et al., Structural basis of actin recognition and arginine ADP-ribosylation by Clostridium perfringens iota-toxin, Proc. Natl. Acad. Sci. USA, 2008, 7399-7404, 105.

Wang et al., A Chimeric Toxin Vaccine Protects against Primary and Recurrent Clostridium difficile Infection, Infection and Immunity, 2012, 2678-2688, 80(8).

Yang et al., Expression of recombinant Clostridium difficile toxin A and B in Bacillus megaterium, BMC Microbiology, 2008, 192, 8.

Zar et al., A Comparison of Vancomycin and Metronidazole for the Treatment of Clostridium difficile—Associated Diarrhea, Stratified by Disease Severity, Clinical Infectious Diseases, 2007, 302-307, 45(3).

Ziegler et al., Conformational Changes and Reaction of Clostridial Glycosylating Toxins, Journal of Molecular Biology, 2008, 1346-1356, 377.

Amit Sundriyal, Structural Studies on Actin-ADP Ribosylating Binary Toxin From C. Difficle, Thesis submitted for the degree of Doctor of Philosophy, University of Bath Department of Biology and Biochemistry, Feb. 1, 2010.

Hossein Khademi et al., The Role of CDT in the Pathogenesis of Clostridium Difficle Associated Disease, Bachelor Project Final Report, Department of Science, Systems and Models, Roskilde University, Apr. 10, 2011.

Jon. H. Heinrichs et al., Design, Production and Pre-Clinical Evaluation of a Novel Toxin-based Vaccine for the Prevention of Clostridium Difficle Disease, 4th International Clostridium Difficle Symposium Abstract Book p. 30, Sep. 20, 2012.

FIG. 2A

```
                              C1 NON-POLAR MOLD
KSEIFLPLDDIKVSPLEV------KIAFANNSVINQALISLKDSYCSDLVINQIKNRYKILNDNLNPSIN------EGTDFNITMKIFSDKLASISNEDWMFMIKITNYLKVGFAPDVRSTI
KSEIFSSLGDMEASPLEV------KIAFNSKGIINQOLISVKDSYCSNLIVKQIENRYKILNNSLNPAIS------EDNDFNTITNIFIDSIMAEANADNGRFMMELGKYLRVGFFPDVKTTI
KSEIFSKLENLNVSDLEI------KIAFALGSVINQALISKQGSYLTNLVIEQVKNRYGFLNQHLNPAIE------SDNWFTDTTKIFHDSLFNSATAENSMFLTKIAPYLQVGFMPFARSTI
INDLILPLGDIKISQLEILLSRLKAATGKKTFSNAFIISNNDSLTLNNLISQLENRYEILNSIIQEAFKICETYDSYINSVSELVLETTPKNLSMDGSSFYQQIIGYILSSGFKPEVNSIV
KSDIFQRLGDIFISELDT------KIAFMFGKIAMQVLISKKNSYSLNLIINQIKNRYNIINKCLSSAIE------KGSNFNNTVDIFIQQL-NEFYVNEGFFVSKVMGYLGDGIMPDMRATL
 :   *:   *::       ::* .*  *     :.**  . .    .:    .   :  :****: :* .        .  :* . : * *:  ** *:   ::  . .:*:

MN AND PO4 BINDING
NLSGPCVYTCAYQDLLMFKDNGTNIHLLEPELRNFEFPKTKISQLIEQEITSLWSFNQARAKSQFEEYKKGYFEGAL         (SEQ ID NO: 62)
NLSGPEAYAAAYQDLLMFKEGSMNIHLIEADLRNFEISKTNISQSTEQEMASLWSFDDARAKAQFEEYKRNYFEGSL         (SEQ ID NO: 63)
SLSGPGATASAYYDFINLQENTIEKTLKASKLIEFKFPENNLSQLTEQEINSLWSFDQASAKYQFEKYVRDYTGGSL         (SEQ ID NO: 64)
FFSGPNIYSSATCDTYHFIRANTFD-MLSSQNQEIFEASNNLYFSKTHDEFKSSMLLRSNIAEKEFQKLIKTYIGRTL        (SEQ ID NO: 65)
NISGPGIYTAAYYDLLYFNERSLNPQILQEDLKYFEVPQALISQQFTEQEINSSWTFNQVKSQIEYKRLVEKYTNKSL        (SEQ ID NO: 66)
 ***  *  : .: ..     :.    :     *.: *** :**  *:**: :: :.  *   ::  :.    *

URIDINE-BINDING RESIDUES    (in TcdB): V101, W102, I103, N139, L265, S269, Y284
GLUCOSE-BINDING RESIDUES    (in TcdB): D270, R273, D286, N384
C1 NON-POLAR MOLD           (in TcdB): I383, I466, P471, W520
DXD MOTIF                   (in TcdB): D286, V287, D288
Mn AND PHOSPHATE-BINDING    (in TcdB): D286, D288, E515, S518, L519
```

FIG. 2B

Toxin A Mutants

| Mutation 1 | Mutation 2 | Mutation 3 | Mutation 4 | Mutation 5 | Strain | DNA Optimization | SEQ ID NO. (nucleotide) | SEQ ID NO. (amino acid) |
|---|---|---|---|---|---|---|---|---|
| W101A | D287A | E514Q | | | VPI 10463 | Native | 1 | 7 |
| W101del | | | | | VPI 10463 | Native | 2 | 8 |
| W101A | D287A | E514Q | | | VPI 10463 | E. coli | 3 | 9 |
| W101A | D287A | E514Q | D285A | | VPI 10463 | E. coli | 4 | 10 |
| W101A | D287A | E514Q | S517A | | VPI 10463 | E. coli | 5 | 11 |
| W101A | D287A | E514Q | W519A | | VPI 10463 | E. coli | 6 | 12 |
| W101A | D287A | E514Q | | | NAP | B. megaterium | 29 | 25 |
| W101A | D287A | E514Q | W519A | C700A | VPI 10463 | B. megaterium | 31 | 26 |
| W101A | D287A | E514Q | W519A | | VPI 10463 | B. megaterium | 30 | 35 |

FIG. 3A

Toxin B Mutants

| Mutation 1 | Mutation 2 | Mutation 3 | Mutation 4 | Mutation 5 | Strain | DNA Optimization | SEQ ID NO. (nucleotide) | SEQ ID NO. (amino acid) |
|---|---|---|---|---|---|---|---|---|
| W102A | D288A | E515Q | | | VPI 10463 | Native | 13 | 19 |
| W102del | | | | | VPI 10463 | Native | 14 | 20 |
| W102A | D288A | E515Q | | | VPI 10463 | E. coli | 15 | 21 |
| W102A | D288A | E515Q | D286A | | VPI 10463 | E. coli | 16 | 22 |
| W102A | D288A | E515Q | S518A | | VPI 10463 | E. coli | 17 | 23 |
| W102A | D288A | E515Q | W520A | | VPI 10463 | E. coli | 18 | 24 |
| W102A | D288A | E515Q | | | NAP | B. megaterium | 32 | 27 |
| W102A | D288A | E515Q | W520A | C698A | NAP | B. megaterium | 34 | 28 |
| W102A | D288A | E515Q | W520A | | VPI 10463 | B. megaterium | 33 | |

FIG.3B

Figure 6: Detoxification of TcdA and TcdB

1. HiMark (420, 247, 214, 160, 107, 64, 51, 39, 28 kDa)
2. TcdA_VPI_4M, Supernatant
3. TcdA_VPI_4M, Supernatant (2x concentrated)
4. TcdA_VPI_4M, Whole broth
5. Bacmin, Supernatant
6. Bacmin, Supernatant (2x concentrated)
7. Bacmin, Whole broth
8. HiMark (420, 247, 214, 160, 107, 64, 51, 39, 28 kDa)

Ham-26 VPI Challenge (707 CFU)

- ●— vpi_toxA/B_cd
- ▽— vpi_5mTcdA_bv/nap_3mTcdB_bm
- ▨— vpi_5mTcdA_bv/nap_4mTcdB_ec
- ◇— vpi_5mTcdA_bv/nap_5mTcdB_bv
- △— vpi_5mTcdA_bv/nap_5mTcdB_bm
- ●— vpi_4mTcdA_bm/nap_3mTcdB_bm
- ●— vpi_4mTcdA_bm/nap_4mTcdB_ec
- ▽— vpi_4mTcdA_bm/nap_5mTcdB_bv
- □— vpi_4mTcdA_bm/nap_5mtcdB_bm
- ◇— vpi_5mTcdA_bm/nap_5mTcdB_bm
- △— vpi_5mTcdA_bm/nap_3mTcdB_bm
- ○— vpi_5mTcdA_bm/nap_4mTcdB_ec
- ●— vpi_5mTcdA_bm/nap_5mTcdB_bv
- ▽— MAA/IMX

FIG.8

>VPI_5mTcdA_BM (W101A, D287A, E514Q, W519A, C700A)
MSLISKEELIKLAYSIRPRENEYKTILTNLDEYNKLTTNNNENKYLQLKKLNESIDVF
MNKYKTSSRNRALSNLKKDILKEVILIKNSNTSPVEKNLHFVAIGGEVSDIALEYIKQWA
DINAEYNIKLWYDSEAFLVNTLKKAIVESSTTEALQLLEEEIQNPQFDNMKFYKKRMEFI
YDRQKRFINYYKSQINKPTVPTIDDIIKSHLVSEYNRDETVLESYRTNSLRKINSNHGID
IRANSLFTEQELLNIYSQELLNRGNLAAASDIVRLLALKNFGGVYLDVAMLPGIHSDLFK
TISRPSSIGLDRWEMIKLEAIMKYKKYINNYTSENFDKLDQQLKDNFKLIIESKSEKSEI
FSKLENLNVSDLEIKIAFALGSVINQALISKQGSYLTNLVIEQVKNRYQFLNQHLNPAIE
SDNNFTDTTKIFHDSLFNSATAENSMFLTKIAPYLQVGFMPEARSTISLSGPGAYASAYY
DFINLQENTIEKTLKASDLIEFKFPENNLSQLTEQQINSLASFDQASAKYQFEKYVRDYT
GGSLSEDNGVDFNKNTALDKNYLLNNKIPSNNVEEAGSKNYVHYIIQLQGDDISYEATCN
LFSKNPKNSIIIQRNMNESAKSYFLSDDGESILELNKYRIPERLKNKEKVKVTFIGHGKD
EFNTSEFARLSVDSLSNEISSFLDTIKLDISPKNVEVNLLGANMFSYDFNVEETYPGKLL
LSIMDKITSTLPDVNKNSITIGANQYEVRINSEGRKELLAHSGKWINKEEAIMSDLSSKE
YIFFDSIDNKLKAKSKNIPGLASISEDIKTLLLDASVSPDTKFILNNLKLNIESSIGDYI
YYEKLEPVKNIIHNSIDDLIDEFNLLENVSDELYELKKLNNLDEKYLISFEDISKNNSTY
SVRFINKSNGESVYVETEKEIFSKYSEHITKEISTIKNSIITDVNGNLLDNIQLDHTSQV
NTLNAAFFIQSLIDYSSNKDVLNDLSTSVKVQLYAQLFSTGLNTIYDSIQLVNLISNAVN
DTINVLPTITEGIPIVSTILDGINLGAAIKELLDEHDPLLKKELEAKVGVLAINMSLSIA
ATVASIVGIGAEVTIFLLPIAGISAGIPSLVNNELILHDKATSVVNYFNHLSESKKYGPL
KTEDDKILVPIDDLVISEIDFNNNSIKLGTCNILAMEGGSGHTVTGNIDHFFSSPSISSH
IPSLSIYSAIGIETENLDFSKKIMMLPNAPSRVFWWETGAVPGLRSLENDGTRLLDSIRD
LYPGKFYWRFYAFFDYAITTLKPVYEDTNIKIKLDKDTRNFIMPTITTNEIRNKLSYSFD
GAGGTYSLLLSSYPISTNINLSKDDLWIFNIDNEVREISIENGTIKKGKLIKDVLSKIDI
NKNKLIIGNQTIDFSGDIDNKDRYIFLTCELDDKISLIIEINLVAKSYSLLLSGDKNYLI
SNLSNTIEKINTLGLDSKNIAYNYTDESNNKYFGAISKTSQKSIIHYKKDSKNILEFYND
STLEFNSKDFIAEDINVFMKDDINTITGKYYVDNNTDKSIDFSISLVSKNQVKVNGLYLN
ESVYSSYLDFVKNSDGHHNTSNFMNLFLDNISFWKLFGFENINFVIDKYFTLVGKTNLGY
VEFICDNNKNIDIYFGEWKTSSSKSTIFSGNGRNVVVEPIYNPDTGEDISTSLDFSYEPL
YGIDRYINKVLIAPDLYTSLININTNYYSNEYYPEIIVLNPNTFHKKVNINLDSSSFEYK
WSTEGSDFILVRYLEESNKKILQKIRIKGILSNTQSFNKMSIDFKDIKKLSLGYIMSNFK
SFNSENELDRDHLGFKIIDNKTYYYDEDSKLVKGLININNSLFYFDPIEFNLVTGWQTIN
GKKYYFDINTGAALTSYKIINGKHFYFNNDGVMQLGVFKGPDGFEYFAPANTQNNNIEGQ
AIVYQSKFLTLNGKKYYFDNNSKAVTGWRIINNEKYYFNPNNAIAAVGLQVIDNNKYYFN
PDTAIISKGWQTVNGSRYYFDTDTAIAFNGYKTIDGKHFYFDSDCVVKIGVFSTSNGFEY
FAPANTYNNNIEGQAIVYQSKFLTLNGKKYYFDNNSKAVTGLQTIDSKKYYFNTNTAEAA
TGWQTIDGKKYYFNTNTAEAATGWQTIDGKKYYFNTNTAIASTGYTIINGKHFYFNTDGI
MQIGVFKGPNGFEYFAPANTDANNIEGQAILYQNEFLTLNGKKYYFGSDSKAVTGWRIIN
NKKYYFNPNNAIAAIHLCTINNDKYYFSYDGILQNGYITIERNNFYFDANNESKMVTGVF
KGPNGFEYFAPANTHNNNIEGQAIVYQNKFLTLNGKKYYFDNDSKAVTGWQTIDGKKYYF
NLNTAEAATGWQTIDGKKYYFNLNTAEAATGWQTIDGKKYYFNTNTFIASTGYTSINGKH
FYFNTDGIMQIGVFKGPNGFEYFAPANTDANNIEGQAILYQNKFLTLNGKKYYFGSDSKA
VTGLRTIDGKKYYFNTNTAVAVTGWQTINGKKYYFNTNTSIASTGYTIISGKHFYFNTDG
IMQIGVFKGPDGFEYFAPANTDANNIEGQAIRYQNRFLYLHDNIYYFGNNSKAATGWVTI
DGNRYYFEPNTAMGANGYKTIDNKNFYFRNGLPQIGVFKGSNGFEYFAPANTDANNIEGQ
AIRYQNRFLHLLGKIYYFGNNSKAVTGWQTINGKVYYFMPDTAMAAAGGLFEIDGVIYFF
GVDGVKAPGIYG* (SEQ ID NO:26)

FIG.9

Nap_5mTcdB_bm (W102A, D288A, E515Q, W520A, C698A)
MSLVNRKQLEKMANVRFRVQEDEYVAILDALEEYHNMSENTVVEKYLKLKDINSLTDI
YIDTYKKSGRNKALKKFKEYLVTEVLELKNNNLTPVEKNLHFVAIGGQINDTAINYINQW
KDVNSDYNVNVFYDSNAFLINTLKKTIVESATNDTLESFRENLNDPRFDYNKFYRKRMEI
IYDKQKNFINYYKTQREENPDLIIDDIVKIYLSNEYSKDIDELNSYIEESLNKVTENSGN
DVRNFEEFKGGESFKLYEQELVERWNLAAASDILRISALKEVGGVYLDVAMLPGIQPDLF
ESIEKPSSVTVDFWEMVKLEAIMKYKEYIPGYTSEHFDMLDEEVQSSFESVLASKSDKSE
IFSSLGDMEASPLEVKIAFNSKGIINQGLISVKDSYCSNLIVKQIENRYKILNNSLNPAI
SEDNDFNTTTNAFIDSIMAEANADNGRFMMELGKYLRVGFFPDVKTTINLSGPEAYAAAY
QDLLMFKEGSMNIHLIEADLRNFEISKTNISQSTEQQMASLASFDDARAKAQFEEYKKNY
FEGSLGEDDNLDFSQNTVVDKEYLLEKISSLARSSERGYIHYIVQLQGDKISYEAACNLF
AKTPYDSVLFQKNIEDSEIAYYYNPGDGEIQEIDKYKIPSIISDRPKIKLTFIGHGKDEF
NTDIFAGLDVDSLSTEIETAIDLAKEDISPKSIEINLLGANMFSYSVNVEETYPGKLLLR
VKDKVSELMPSISQDSIIVSANQYEVRINSEGRRELLDHSGEWINKEESIIKDISSKEYI
SFNPKENKIIVKSKNLPELSTLLQEIRNNSNSSDIELEEKVMLAECEINVISNIDTQVVE
GRIEEAKSLTSDSINYIKNEFKLIESISDALYDLKQQNELEESHFISFEDILETDEGFSI
RFIDKETGESIFVETEKAIFSEYANHITEEISKIKGTIFDTVNGKLVKKVNLDATHEVNT
LNAAFFIQSLIEYNSSKESLSNLSVAMKVQVYAQLFSTGLNTITDAAKVVELVSTALDET
IDLLPTLSEGLPVIATIIDGVSLGAAIKELSETSDPLLRQEIEAKIGIMAVNLTAATTAI
ITSSLGIASGFSILLVPLAGISAGIPSLVNNELILRDKATKVVDYFSHISLAESEGAFTS
LDDKIMMPQDDLVISEIDFNNNSITLGKCEIWRMEGGSGHTVTDDIDHFFSAPSITYREP
HLSIYDVLEVQKEELDLSKDLMVLPNAPNRVFAWETGWTPGLRSLENDGTKLLDRIRDNY
EGEFYWRYFAFIADALITTLKPRYEDTNIRINLDSNTRSFIVPVITTEYIREKLSYSFYG
SGGTYALSLSQYNMNINIELNENDTWVIDVDNVVRDVTIESDKIKKGDLIENILSKLSIE
DNKIILDNHEINFSGTLNGGNGFVSLTFSILEGINAVIEVDLLSKSYKVLISGELKTLMA
NSNSVQQKIDYIGLNSELQKNIPYSFMDDKGKENGFINCSTKEGLFVSELSDVVLISKVY
MDNSKPLFGYCSNDLKDVKVITKDDVIILTGYYLKDDIKISLSFTIQDENTIKLNGVYLD
ENGVAEILKFMNKKGSTNTSDSLMSFLESMNIKSIFINSLQSNTKLILDTNFIISGTTSI
GQFEFICDKDNNIQPYFIKFNTLETKYTLYVGNRQNMIVEPNYDLDDSGDISSTVINFSQ
KYLYGIDSCVNKVIISPNIYTDEINITPIYEANNTYPEVIVLDTNYISEKINININDLSI
RYVWSNDGSDFILMSTDEENKVSQVKIRFTNVFKGNTISDKISFNFSDKQDVSINKVIST
FTPSYYVEGLLNYDLGLISLYNEKFYINNFGMMVSGLVYINDSLYYFKPPIKNLITGFTT
IGDDKYYFNPDNGGAASVGETIIDGKNYYFSQNGVLQTGVFSTEDGFKYFAPADTLDENL
EGEAIDFTGKLTIDENVYYFGDNYRAAIEWQTLDDEVYYFSTDTGRAFKGLNQIGDDKFY
FNSDGIMQKGFVNINDKTFYFDDSGVMKSGYTEIDGKYFYFAENGEMQIGVFNTADGFKY
FAHHDEDLGNEEGEALSYSGILNFNNKIYYFDDSFTAVVGWKDLEDGSKYYFDEDTAEAY
IGISIINDGKYYFNDSGIMQIGFVTINNEVFYFSDSGIVESGMQNIDDNYFYIDENGLVQ
IGVFDTSDGYKYFAPANTVNDNIYGQAVEYSGLVRVGEDVYYFGETYTIETGWIYDMENE
SDKYYFDPETKKAYKGINVIDDIKYYFDENGIMRTGLITFEDNHYYFNEDGIMQYGYLNI
EDKTFYFSEDGIMQIGVFNTPDGFKYFAHQNTLDENFEGESINYTGWLDLDEKRYYFTDE
YIAATGSVIIDGEEYYFDPDTAQLVISE* (SEQ ID NO:28)

VCNTTYKAPIERPEDFLKDKEKAKEWERKEAERIEQKLERSEKEALESYKKDSVEISKY
SQTRNYFYDYQIEANSREKEYKELRNAISKNKIDKPMYVYYFESPEKFAFNKVIRTENQN
EISLEKFNEFKETIQNKLFKQDGFKDISLYEPGKGDEKPTPLLMHLKLPRNTGMLPYTNT
NNVSTLIEQGYSIKIDKIVRIVIDGKHYIKAEASVVSSLDFKDDVSKGDSWGKANYNDWS
NKLTPNELADVNDYMRGGYTAINNYLISNGPVNNPNPELDSKITNIENALKREPIPTNLT
VYRRSGPQEFGLTLTSPEYDFNKLENIDAFKSKWEGQALSYPNFISTSIGSVNMSAFAKR
KIVLRITIPKGSPGAYLSAIPGYAGEYEVLLNHGSKFKINKIDSYKDGTITKLIVDATLI
P* (SEQ ID NO:38)

FIG.13A

VCNTTYKAPIERPEDFLKDKEKAKEWERKEAERIEQKLERSEKEALESYKKDSVEISKY
SQTRNYFYDYQIEANSREKEYKELRNAISKNKIDKPMYVYYFESPEKFAFNKVIRTENQN
EISLEKFNEFKETIQNKLFKQDGFKDISLYEPGKGDEKPTPLLMHLKLPRNTGMLPYTNT
NNVSTLIEQGYSIKIDKIVRIVIDGKHYIKAEASVVSSLDFKDDVSKGDSWGKANYNDWS
NKLTPNELADVNDYMRGGYTAINNYLISNGPVNNPNPELDSKITNIENALKREPIPTNLT
VYARSGPQEFGLTLTSPEYDFNKLENIDAFKSKWEGQALSYPNFISTSIGSVNMSAFAKR
KIVLRITIPKGSPGAYLSAIPGYAGAYDVLLNHGSKFKINKIDSYKDGTITKLIVDATLI
P* (SEQ ID NO:40)

FIG.13B

VCNTTYKAPIERPEDFLKDKEKAKEWERKEAERIEQKLERSEKEALESYKKDSVEISKY
SQTRNYFYDYQIEANSREKEYKELRNAISKNKIDKPMYVYYFESPEKFAFNKVIRTENQN
EISLEKFNEFKETIQNKLFKQDGFKDISLYEPGKGDEKPTPLLMHLKLPRNTGMLPYTNT
NNVSTLIEQGYSIKIDKIVRIVIDGKHYIKAEASVVSSLDFKDDVSKGDSWGKANYNDWS
NKLTPNELADVNDYMRGGYTAINNYLISNGPVNNPNPELDSKITNIENALKREPIPTNLT
VYRRSGPQEFGLTLTSPEYDFNKLENIDAFKSKWEGQALSYPNFIFTSIGSVNMSAFAKR
KIVLRITIPKGSPGAYLSAIPGYAGQYQVLLNHGSKFKINKIDSYKDGTITKLIVDATLI
P* (SEQ ID NO:42)

FIG.13C proCDTb
EIVNEDILPNNGLMGYYFTDEHFKDLKLMAPIKDGNLKFEEKKVDKLLDKDKSDVKSIRW
TGRIIPSKDGEYTLSTDRDDVLMQVNTESTISNTLKVNMKKGKEYKVRIELQDKNLGSID
NLSSPNLYWELDGMKKIIPEENLFLRDYSNIEKDDPFIPNNNFFDPKLMSDWEDEDLDTD
NDNIPDSYERNGYTIKDLIAVKWEDSFAEQGYKKYVSNYLESNTAGDPYTDYEKASGSFD
KAIKTEARDPLVAAYPIVGVGMEKLIISTNEHASTDQGKTVSRATTNSKTESNTAGVSVN
VGYQNGFTANVTTNYSHTTDNSTAVQDSNGESWNTGLSINKGESAYINANVRYYNTGTAP
MYKVTPTTNLVLDGDTLSTIKAQENQIGNNLSPGDTYPKKGLSPLALNTMDQFSSRLIPI
NYDQLKKLDAGKQIKLETTQVSGNFGTKNSSGQIVTEGNSWSDYISQIDSISASIILDTE
NESYERRVTAKNLQDPEDKTPELTIGEAIEKAFGATKKDGLLYFNDIPIDESCVELIFDD
NTANKIKDSLKTLSDKKIYNVKLERGMNILIKTPTYFTNFDDYNNYPSTWSNVNTTNQDG
LQGSANKLNGETKIKIPMSELKPYKRYVFSGYSKDPLTSNSIIVKIKAKEEKTDYLVPEQ
GYTKFSYEFETTEKDSSNIEITLIGSGTTYLDNLSITELNSTPEILDEPEVKIPTDQEIM
DAHKIYFADLNFNPSTGNTYINGMYFAPTQTNKEALDYIQKYRVEATLQYSGFKDIGTKD
KEMRNYLGDPNQPKTNYVNLRSYFTGGENIMTYKKLRIYAITPDDRELLVLSVD*
(SEQ ID NO:44)

FIG.14A

CDTb
LMSDWEDEDLDTDNDNIPDSYERNGYTIKDLIAVKWEDSFAEQGYKKYVSNYLESNT
AGDPYTDYEKASGSFDKAIKTEARDPLVAAYPIVGVGMEKLIISTNEHASTDQGKTVSRA
TTNSKTESNTAGVSVNVGYQNGFTANVTTNYSHTTDNSTAVQDSNGESWNTGLSINKGES
AYINANVRYYNTGTAPMYKVTPTTNLVLDGDTLSTIKAQENQIGNNLSPGDTYPKKGLSP
LALNTMDQFSSRLIPINYDQLKKLDAGKQIKLETTQVSGNFGTKNSSGQIVTEGNSWSDY
ISQIDSISASIILDTENESYERRVTAKNLQDPEDKTPELTIGEAIEKAFGATKKDGLLYF
NDIPIDESCVELIFDDNTANKIKDSLKTLSDKKIYNVKLERGMNILIKTPTYFTNFDDYN
NYPSTWSNVNTTNQDGLQGSANKLNGETKIKIPMSELKPYKRYVFSGYSKDPLTSNSIIV
KIKAKEEKTDYLVPEQGYTKFSYEFETTEKDSSNIEITLIGSGTTYLDNLSITELNSTPE
ILDEPEVKIPTDQEIMDAHKIYFADLNFNPSTGNTYINGMYFAPTQTNKEALDYIQKYRV
EATLQYSGFKDIGTKDKEMRNYLGDPNQPKTNYVNLRSYFTGGENIMTYKKLRIYAITPD
DRELLVLSVD* (SEQ ID NO:46)

FIG.14B

Residue No. 1
↓

<u>MKKFRKHKRISNCISILLILYLTLGGLLPNNIYAQDLQSYSEK</u>VCNTTYKAPIERP
EDFLKDKEKAKEWERKEAERIEQKLERSEKEALESYKKDSVEISKYSQTRNYFYDY
QIEANSREKEYKELRNAISKNKIDKPMYVYYFESPEKFAFNKVIRTENQNEISLEK
FNEFKETIQNKLFKQDGFKDISLYEPGKGDEKPTPLLMHLKLPRNTGMLPYTNTNN
VSTLIEQGYSIKIDKIVRIVIDGKHYIKAEASVVSSLDFKDDVSKGDSWGKANYND
WSNKLTPNELADVNDYMRGGYTAINNYLISNGPVNNPNPELDSKITNIENALKREP
IPTNLTVYRRSGPQEFGLTLTSPEYDFNKLENIDAFKSKWEGQALSYPNFISTSIG
SVNMSAFAKRKIVLRITIPKGSPGAYLSAIPGYAGEYEVLLNHGSKFKINKIDSYK
DGTITKLIVDATLIP (SEQ ID NO:59)

FIG.15

```
TcdA    1 MSLISKEELIKLA-YSIRPRENEYKTILTNLDEYNKLTTNNNENKYLQLK  49
TcdB    1 MSLVNRKQLEKMANVRFRTQEDEYVAILDALEEYHNMSENTVVEKYLKLK  50

TcdA   50 KLNESIDVFMNKYKTSSRNRALSNLKKDILKEVILIKNSNTSPVEKNLHF  99
TcdB   51 DINSLTDIYIDTYKKSGRNKALKKFKEYLVTEVLELKNNNLTPVEKNLHF 100

TcdA  100 VWIGGEVSDIALEYIKQWADINAEYNIKLWYDSEAFLVNTLKKAIVESST 149
TcdB  101 VWIGGQINDTAINYINQWKDVNSDYNVNVFYDSNAFLINTLKKTVVESAI 150

TcdA  150 TEALQLLEEEIQNPQFDNMKFYKKRMEFIYDRQKRFINYYKSQINKPTVP 199
TcdB  151 NDTLESFRENLNDPRFDYNKFFRKRMEIIYDKQKNFINYYKAQREENPEL 200

TcdA  200 TIDDIIKSHLVSEYNRDETVLESYRTNSLRKINSNHGIDIRANSLFTEQE 249
TcdB  201 IIDDIVKTYLSNEYSKEIDELNTYIEESLNKITQNSGNDVRNFEEFKNGE 250

TcdA  250 LLNIYSQELLNRGNLAAASDIVRLLALKNFGGVYLDVDMLPGIHSDLFKT 299
TcdB  251 SFNLYEQELVERWNLAAASDILRISALKEIGGMYLDVDMLPGIQPDLFES 300

TcdA  300 ISRPSSIGLDRWEMIKLEAIMKYKKYINNYTSENFDKLDQQLKDNFKLII 349
TcdB  301 IEKPSSVTDFWEMTKLEAIMKYKEYIPEYTSEHFDMLDEEVQSSFESVL 350

TcdA  350 ESKSEKSEIFSKLENLNVSDLEIKIAFALGSVINQALISKQGSYLTNLVI 399
TcdB  351 ASKSDKSEIFSSLGDMEASPLEVKIAFNSKGIINQGLISVKDSYCSNLIV 400

TcdA  400 EQVKNRYQFLNQHLNPAIESDNNFTDTTKIFHDSLFNSATAENSMFLTKI 449
TcdB  401 KQIENRYKILNNSLNPAISEDNDFNTTTNTFIDSIMAEANADNGRFMMEL 450

TcdA  450 APYLQVGFMPEARSTISLSGPGAYASAYYDFINLQENTIEKTLKASDLIE 499
TcdB  451 GKYLRVGFFPDVKTTINLSGPEAYAAAYQDLLMFKEGSMNIHLIEADLRN 500

TcdA  500 FKFPENNLSQLTEQEINSLWSFDQASAKYQFEKYVRDYTGGSLSEDNGVD 549
TcdB  501 FEISKTNISQSTEQEMASLWSFDDARAKAQFEEYKRNYFEGSLGEDDNLD 550

TcdA  550 FNKNTALDKNYLLNNKIPSNNVEEAGSKNYVHYIIQLQGDDISYEATCNL 599
TcdB  551 FSQNIVVDKEYLLE-KISS--LARSSERGYIHYIVQLQGDKISYEAACNL 597

TcdA  600 FSKNPKNSIIQRNMNESAKSYFLSDDGESILELNKYRIPERLKNKEKVK 649
TcdB  598 FAKTPYDSVLFQKNIEDSEIAYYYNPGDGEIQEIDKYKIPSIISDRPKIK 647

TcdA  650 VTFIGHGKDEFNTSEFARLSVDSLSNEISSFLDTIKLDISPKNVEVNLLG 699
TcdB  648 LTFIGHGKDEFNTDIFAGFDVDSLSTEIEAAIDLAKEDISPKSIEINLLG 697

TcdA  700 CNMFSYDFNVEETYPGKLLL 719 (SEQ ID NO: 60)
TcdB  698 CNMFSYSINVEETYPGKLLL 717 (SEQ ID NO: 61)
```

FIG.16

| Grp | vpi_5mTcdA_bv (µg) | nap_5mTcdB_bv (µg) | 3m_CdtA2_bv (µg) | proCdtB_bv (µg) | n | Adjuvant ID | Adjuvant dose | Formaldehyde | Dosing |
|---|---|---|---|---|---|---|---|---|---|
| 01 | 20 | 20 | 5 | 5 | 3 | IMX | 60 µg IMX | Yes | Days 0, 7, 30 |
| 02 | 20 | 20 | 5 | 5 | 3 | MAA | 112.5 µg MAA | Yes | Days 0, 7, 30 |
| 03 | 20 | 20 | 5 | 5 | 3 | MAA | 112.5 µg MAA | No | Days 0, 7, 30 |
| 04 | 20 | 20 | 5 | 5 | 3 | IMX, MAA | 60 µg IMX, 112.5 µg MAA | Yes | Days 0, 7, 30 |
| 05 | 20 | 20 | 5 | 5 | 3 | IMX, MAA | 60 µg IMX, 112.5 µg MAA | No | Days 0, 7, 30 |
| 06 | 20 | 20 | 5 | 5 | 3 | IMO, MAA | 2.5mg IMO2170, 112.5 µg MAA | Yes | Days 0, 5, 10, 30 |
| 07 | 20 | 20 | 5 | 5 | 3 | None | - | Yes | Days 0, 5, 10, 30 |
| 08 | 20 | 20 | 5 | 5 | 3 | IMX | 60 µg IMX | Yes | Days 0, 5, 10, 30 |
| 09 | 20 | 20 | 5 | 5 | 3 | MAA | 112.5 µg MAA | Yes | Days 0, 5, 10, 30 |
| 10 | 20 | 20 | 5 | 5 | 3 | MAA | 112.5 µg MAA | No | Days 0, 5, 10, 30 |
| 11 | 20 | 20 | 5 | 5 | 3 | IMX, MAA | 60 µg IMX, 112.5 µg MAA | Yes | Days 0, 5, 10, 30 |

FIG. 19C

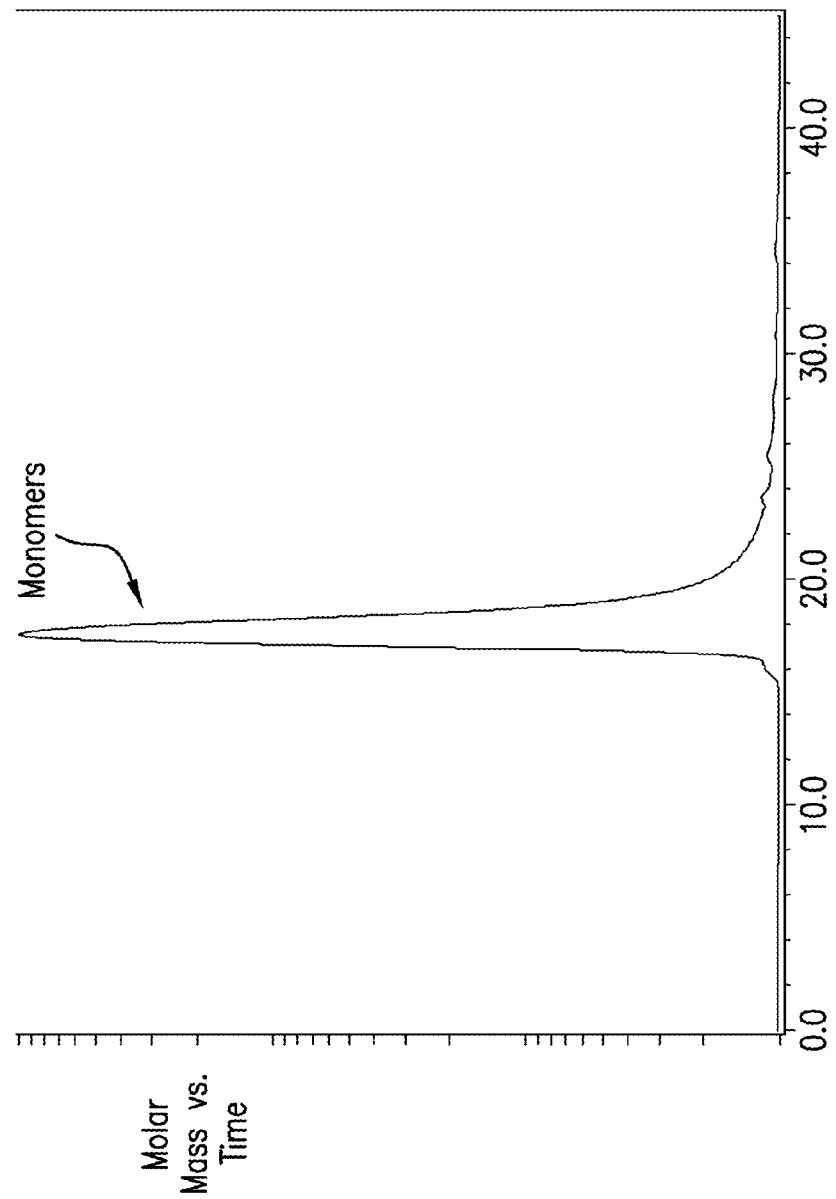

VACCINES AGAINST CLOSTRIDIUM DIFFICILE COMPRISING RECOMBINANT TOXINS

CROSS-REFERENCE TO RELATED APPLICATIONS

This application is a §371 National Stage Application of PCT/US2013/023189, international filing date of Jan. 25, 2013, which claims the benefit of U.S. Provisional Application No. 61/591,631, filed Jan. 27, 2012, U.S. Provisional Application No. 61/596,419, filed Feb. 8, 2012, and U.S. Provisional Application No. 61/703,754, filed Sep. 20, 2012, the contents of which are hereby incorporated by reference in their entirety.

FIELD OF THE INVENTION

The present invention relates to methods of inducing an immune response to *Clostridium difficile* using at least one recombinant toxin protein selected from Toxin A (TcdA), Toxin B (TcdB) and binary toxin (CDTa, and CDTb) protein from *Clostridium difficile* as well as combinations with additional immunogens. The present invention also relates to an immunogenic composition, particularly a *C. difficile* vaccine, comprising a CDTa and/or CDTb protein, alone or in combination with one or more additional immunogens such as TcdA and TcdB, which is capable of inducing a protective immune response.

REFERENCE TO SEQUENCE LISTING SUBMITTED ELECTRONICALLY

The sequence listing of the present application is submitted electronically via EFS-Web as an ASCII formatted sequence listing with a file name "23192USPCT-SEQLIST-25JUL2014.TXT", creation date of Jul. 25, 2014, and a size of 1.14 MB. This sequence listing submitted EFS-Web is part of the specification and is herein incorporated by reference in its entirety.

BACKGROUND OF THE INVENTION

*Clostridium* is a genus of anaerobic Gram-positive spore-forming bacterium that is implicated in the decomposition and degradation of organic matters in soil and the anaerobic compartments of mammalian gastrointestinal tracts. To affect their function, many *Clostridium* spp. encode and express degradative enzymes targeting various components of living matter. Some of these enzymes have evolved into highly potent toxins and cytotoxins. The expression of these toxins can turn some *Clostridium* species into opportunistic pathogens, including *Clostridium tetani*, *Clostridium botulinum*, *Clostridium perfringens* and *Clostridium difficile*, which cause tetanus, botulism, gas gangrene, and antibiotic-associated colitis, respectively.

*C. difficile* infection (CDI) is one of the most common nosocomial infections in industrialized nations, often prevalent in hospital patients undergoing antibiotic therapy due to the disruption of normal colonic flora caused by the antibacterial agent(s). There are an estimated 500,000 CDI cases in the United States each year (Campbell et al., *Infect Control Hosp Epidemiol*, 30(6): 526-33 (2009); Rupnik et al., *Nature Reviews*, 7: 527-36 (2009)). The number of *C. difficile* cases reported in the United States has risen, as noted by an increase of 92% from 2001 to 2005 in the rate of hospitalizations with CDI discharge diagnoses. Almost all antibiotics, including clindamycin, cephalosporins, penicillins, and fluoroquinolones, have been associated with symptomatic disease caused by toxigenic *C. difficile* (Bartlett, J. G., *Clin Infect Dis.* 46(10): 1489-92 (2008); Gorbach, S. L., *N Engl J Med*, 341 (22): 1690-1 (1999); Kelly et al., *N Engl J Med* 330(4): 257-62 (1994)). *C. difficile*-associated disease (CDAD) includes antibiotic-associated diarrhea, colitis and pseudomembranous colitis and in some cases, may progress to toxic megacolon, sepsis and death. For this reason, CDI is a major healthcare concern. Although some patients suffering from CDAD respond to cessation of antibiotic therapy, most require treatment with further agents, such as metronidazole or vancomycin (reviewed in DuPont et al., *Current Opinion in Infectious Diseases* 21:500-507 (2008)). Existing therapies often fail to eliminate CDAD or lead to recurrent illness; thus, new methods of prophylactic or therapeutic treatment are needed.

Over the last decade, increases in severe or fatal infections, standard of care therapy failures, emergence of a more virulent, epidemic strain (NAP1/027/BI), increasing community acquired infection, and the incidence of recurrent infection (estimated to be ~15-25%) have contributed to an increased necessity for therapeutic and/or prophylactic treatments for CDI (Aslam et al., *Lancet*, 365(9469): 1464 (2005); Loo, et al., *N Engl J Med*, 365(18): 1693-703 (2006); McDonald et al., *N Engl J Med*, 353(23): 2433-41 (2005); Muto, C. A., *Infect Control Hosp Epidemiol*, 26(1): 10-2 (2005); Pépin et al., *Cmaj.*, 171(5): 466-72 (2004); Zar, et al., *Clin Infect Dis*, 45(3): 302-7. (2007)). Several studies have recently suggested that the incidence of community acquired CDI has increased (MMWR Morb Mortal Wkly Rep, 57(13): 340-3 (2008); Hirschhorn et al., *J Infect Dis.*, 169(1): 127-33 (1994); Karlstrom et al., *Clin Infect Dis*, 26(1): 141-5 (1998); Kyne et al., *J Infect*, 36(3): 287-8 (1998); Lambert et al., *Infect Control Hosp Epidemiol*, 30(10): 945-51 (2009); Noren et al., *J Clin Microbiol*, 42(8): p. 3635-43 (2004); Paltansing et al., *Clin Microbiol Infect*, 13(11): 1058-64 (2007).

Toxigenic isolates of *Clostridium difficile* usually encode two large clostridial toxins, referred to as toxin A and toxin B ("TcdA" and "TcdB"), which are part of a larger family of toxins called large Clostridial toxins (LCT), due to their unusual large molecular weight (>250 kDa) and mechanism of action (Schirmer and Aktories, *Biochimica et Biophysica Acta* 1673: 66-74 (2004)). Additional toxigenic strains express only toxin B and not toxin A. TcdA and TcdB have been demonstrated to be the sole causative agents of CDI. A subset of *C. difficile* strains also produce an actin-ADP-ribosylating toxin, referred to as *C. difficile* transferase, or CDT. This toxin, which is commonly referred to as binary toxin, is particularly associated with highly virulent, epidemic strains such as NAP1/027/BI and consists of the two proteins CDTa and CDTb.

The CDTb subunit forms a heptameric ring-like structure which permits entry into the cytoplasm of the enzymatically active, CDTa protein. The CDTa protein catalyzes the ADP-ribosylation of G-actin at Arginine 177 and prevents actin polymerization (Barth, H., et al., Binary bacterial toxins: biochemistry, biology, and applications of common *Clostridium* and *Bacillus* proteins. *Microbiol Mol Biol Rev*, 68(3): 373-402 (2004)). The precise role of binary toxin in the pathogenesis of *C. difficile* disease is poorly defined; however, these toxins have been shown to function as enterotoxins (Geric, B., et al., *Journal of Infectious Diseases* 193(8): 1143-1150 (2006)) to induce the formation of microtubules and, thereby increase *C. difficile* colonization (Schwan, C., et al., *PLoS Pathog*, 5(10): e1000626 (2009)), and have been more recently associated with increased mortality compared to non-binary toxin containing strains (Bacci et al., *Emerg. Infect. Dis.*, 17(6): 976-82 (2011); Goldenberg S D, *Journal of Infection*, 62: 355-62 (2011)).

Several approaches to *C. difficile* vaccine development are described in the literature, including passive immunization with *C. difficile* toxin-neutralizing polyclonal serum (see Thomas et al., WO 99/20304 and WO 2005/058353), immunization with toxin fragments (Ward et al., WO 98/59053; Lyerly et al., *Current Microbiology* 21: 29-32 (1990); WO 00/061761) and immunization with formalin-inactivated fully native toxin (Torres et al., *Infection and Immunity* 63(12): 4619-4627 (1995); Kim et al., *Infection and Immunity* 55(12): 2984-2992(1987)); Fernie et al. *Devel. Biol. Standard* 53: 325-32 (1983); Libby et al., *Infect Immun* 36: 822-9 (1982); Ghose et al., *Infection and Immunity* 75(6): 2826-2832). Also described are DNA-based vaccines encoding toxin fragments (Gardiner et al., *Vaccine* 27:3598-3604 (2009)), including binary toxin (J. E. Galen, WO 2011/060431). Ellingsworth et al. (WO 2012/028741) disclose a recombinant fusion protein comprising the receptor binding domains of TcdA and TcdB.

Also described is the use of recombinant toxin-based vaccines in which specific sites that contribute to toxicity are mutated. Ballard and Spyres describe a recombinant TcdB vaccine in which the cysteine at position 395 is replaced with another amino acid (U.S. Pat. No. 7,226,597). Other sites described as important to enzyme activity are the tryptophan residue at position 102 (W102) of TcdB and the catalytic triad motif DXD which is a signature motif of the glycosyltransferase A family, of which LCTs are part (Busch et al., *J Biol. Chem.* 275(18): 13228-234 (2000)). Feng et al. (WO 2011/068953) describe TcdA toxins with single, double, or triple mutations and a TcdB toxin with double mutations to eliminate toxicity.

SUMMARY OF THE INVENTION

The invention described herein relates to recombinant *C. difficile* toxin A (TcdA) protein comprising or consisting of at least 3 mutations selected from the group consisting of: W101A, D287A, E514Q, D285A, S517A, W519A, and C700A. In preferred embodiments of the invention, the recombinant TcdA protein comprises or consists of a set of mutations selected from the group consisting of: (a) W101A, D287A and E514Q; (b) W101A, D287A, E514Q, and W519A; (c) W101A, D287A, E514Q and D285A; (d) W101A, D287A, E514Q and S517A; and (e) W101A, D287A, E514Q, W519A, and C700A. In additional embodiments, the TcdA protein is substantially purified.

The invention further relates to a recombinant *C. difficile* toxin B (TcdB) protein comprising or consisting of at least 3 mutations selected from the group consisting of: W102A, D288A, E515Q, D286A, S518A, W520A, and C698A. In preferred embodiments of this aspect of the invention, the purified TcdB protein comprises a set of mutations selected from the group consisting of: (a) W102A, D288A, and E515Q; (b) W102A, D288A, E515Q, and W520A; (c) W102A, D288A, E515Q and D286A; (d) W102A, D288A, E515Q and S518A; and (e) W102A, D288A, E515Q, W520A, and C698A. In additional embodiments, the TcdB protein is substantially purified.

The invention also relates to vaccines and immunogenic compositions comprising the TcdA and/or TcdB mutant toxins described herein with a pharmaceutically acceptable carrier. In preferred embodiments, the compositions and vaccines comprise a TcdA and a TcdB mutant protein. The compositions and vaccines may further comprise an adjuvant, such as an aluminum adjuvant and/or ISCOMATRIX®.

The invention further relates to the production of the TcdA and TcdB mutant proteins by expression of a nucleotide sequence encoding the TcdA or TcdB protein sequence in cell culture under conditions which allow expression of the nucleotide sequence, to produce the recombinant mutant protein, which may be isolated and/or purified. In a specific embodiment of the invention, the TcdA and TcdB mutant toxin proteins are produced using the baculovirus expression system in insect cell culture.

The invention also relates to a recombinant binary toxin protein A (CDTa) comprising at least two mutations selected from C2A, Y67A, Y69A, Y253A, R255A, Y258A, R302A, Q307E, N342A, S345F, F356A, R359A, Y382A, E385Q, E385A, E387Q, and E387D. In some embodiments, the CDTa mutations are selected from: C2A, R302A, S345F, E385Q, E385A, E387Q, and E387D. In embodiments of this aspect of the invention, the CDTa protein comprises a set of mutations selected from the group consisting of: (a) S345F, E385Q and E387Q; (b) R302A, E385A, E387D; (c) C2A, S345F, E385Q and E387Q; (d) R302A, S345F, E385Q and E387Q; (e) Y67A, Y69A, and R255A; (f) R359A, Y67A, and Q307E; (g) Y258A, F356A, S345F; and (h) N342A, Y253A and Y382A. In preferred embodiments of the invention, the CDTa protein lacks a signal peptide. In additional embodiments of the invention, the CDTa protein is substantially purified.

The invention further relates to nucleic acid molecules comprising a sequence of nucleotides that encode the TcdA, TcdB, CDTa, and CDTb proteins described herein. In some embodiments, the nucleotide sequences are codon-optimized for optimal expression in the host cell of choice, for example, *E. coli* or *B. megaterium*. Further provided herein are vectors and host cells comprising the nucleotide sequences of the invention.

Also provided herein are immunogenic compositions comprising the TcdA, TcdB, and/or CDTa proteins described herein and binary toxin protein B (CDTb) protein from *C. difficile* and a pharmaceutically acceptable carrier. In preferred embodiments of the invention, the CDTb protein lacks a signal peptide. In additional embodiments, the CDTb protein further lacks an activation domain. In preferred embodiments, the compositions comprise TcdA, TcdB, CDTa and CDTb proteins, along with a pharmaceutically acceptable carrier. In some embodiments of the invention, the immunogenic compositions further comprise an adjuvant.

The invention also relates to a method of producing CDTa or CDTb protein, comprising transforming a cell with a vector comprising a nucleic acid sequence that encodes the CDTa or CDTb protein under conditions that permit expression of the nucleotide sequence to produce the CDTa or CDTb protein.

Also provided herein are methods of treating and/or preventing *C. difficile*-associated disease comprising administering to a patient an effective amount of the immunogenic composition or vaccines of the invention.

As used throughout the specification and in the appended claims, the singular forms "a," "an," and "the" include the plural reference unless the context clearly dictates otherwise.

Throughout the application, reference to "comprising" is open-ended and allows for the addition of further elements, e.g. mutations. In an embodiment, reference to "comprising" throughout the application can be "consisting" or "consisting essentially of." In some cases, the term "consisting" is used to highlight the possibility of the embodiment with the term "consisting."

In general discussion of toxin mutations throughout the text, wherein the discussion is not specifically referring to either TcdA or TcdB, amino acid residue numbering refers to the proper numbering for TcdB, unless otherwise indicated (text specifically directed to TcdA provides the proper numbering for TcdA and text specifically directed to TcdB provides the proper numbering for TcdB). Due to a single amino-acid deletion in TcdA following residue number 13 (relative to TcdB, see FIG. 16 for alignment of TcdA and TcdB), the residue numbering for toxin A mutations is shifted by one unit for Toxin A relative to Toxin B (i.e., for TcdA, residue numbering for the mutations described herein is n−1 relative to TcdB; e.g. W102 in TcdB is W101 in TcdA). An exception is the cysteine mutation C700A in TcdA, which is C698A in TcdB due to the presence of an additional three residues in the cysteine protease domain of TcdA (see FIG. 16).

As used throughout the specification and appended claims, the following definitions and abbreviations apply:

"TcdA" and "TcdB" refer to toxin A and toxin B, respectively, which are large clostridial toxins from toxigenic isolates of *Clostridium difficile*, and mutant and derivatives thereof, which are described herein. Reference to "TcdA" and/or "TcdB" does not require that the proteins are produced using *C. difficile* as an expression system, i.e. different expression systems can be employed as described herein.

"CDTa" and "CDTb" are subunit protein A and B, respectively, from the actin-ADP-ribosylating toxin, referred to as *C. difficile* transferase, or CDT, which is also known as binary toxin. As defined herein, "CDTa" and "CDTb" includes mutants and derivatives of native or wild-type CDTa and CDTb, which are described herein. Reference to "CDTa" and/or "CDTb" does not require that the proteins are produced using *C. difficile* as an expression system, i.e. different expression systems can be employed as described herein.

Mutants are generally referred to herein as follows: Toxin A with 3 point mutations (3mTcdA), Toxin B with 3 point mutations (3mTcdB), Toxin A with 4 point mutations (4mTcdA), Toxin B with 4 point mutations (4mTcdB), Toxin A with 5 point mutations (5mTcdA) and Toxin B with 5 point mutations (5mTcdB).

Specific mutants of binary toxin A are referred to as follows: 3mCDTa1 refers to CDTa minus the signal peptide with the following mutations: R302A, E385A, and E387D. 3mCDTa2 refers to CDTa minus the signal peptide with the following mutations: S345F, E385Q and E387Q. 4mCDTa3 refers to CDTa minus the signal peptide with the following mutations: R302A, S345F, E385Q, and E387Q. 3mCDTa4 refers to CDTa minus the signal peptide with the following mutations: Y62A, Y69A, and R255A. 3mCDTa5 refers to CDTa minus the signal peptide with the following mutations: R359A, Y62A, and Q307E. 3mCDTa6 refers to CDTa minus the signal peptide with the following mutations: Y258A, F356A, and S345F. 3mCDTa7 refers to CDTa minus the signal peptide with the following mutations: N342A, Y253A, and Y382A. 4mCDTa8 refers to CDTa minus the signal peptide with the following mutations: S345F, E385Q, E387Q, and C2A. Reference sequences obtained from the NAP1 strain R20291 for CDTa minus the signal peptide (i.e. no mutations), 3mCDTa1 and 3mCDTa2 are provided as SEQ ID NO:38, SEQ ID NO:40 and SEQ ID NO:42, respectively (see FIG. 13). A reference sequence for 4mCDTa8 derived from the Nap strain is provided as SEQ ID NO:67. Actual amino acid sequences of CDTa and mutant versions of CDTa used for the studies described herein contained an additional N-terminal methionine relative to the sequences provided in SEQ ID NO's 38, 40, 42, and 67. With regard to reference sequences useful for providing the CDTa sequences of the invention, one skilled in the art will realize that CDTa sequences from other strains that express binary toxin may also provide the backbone sequence for 3mCDTa1, 3mCDTa2, or 4mCDTa8, and such sequences may have minor variations from the NAP1 reference strain sequence provided. Residue numbering for CDTa begins at the N-terminal residue (Valine in the NAP1 reference strain), after the signal peptide is deleted from the native CTDa amino acid sequence (see FIG. 15).

Additional abbreviations employed herein include the following: bm=*Bacillus megaterium* expression system; bv=baculovirus expression system; cd=*Clostridium difficile* expression system; ec=*Escherichia coli* expression system; NAP=NAP1/027/BI17 strain; VPI=VPI10463 strain.

"Effective amount" means sufficient vaccine or immunogenic composition is introduced to a patient to produce a desired effect such as inducing an immune response against *C. difficile* in the patient or preventing *C. difficile* infection. One skilled in the art recognizes that this level may vary.

"MAA" means an amorphous aluminum hydroxyphosphate sulfate adjuvant.

As used herein, an "ISCOM-type adjuvant" is an adjuvant comprising an immune stimulating complex (ISCOM), which is comprised of a saponin, cholesterol, and a phospholipid, which together form a characteristic caged-like particle, having a unique spherical, caged-like structure that contributes to its function (for review, see Barr and Mitchell, *Immunology and Cell Biology* 74: 8-25 (1996)). This term includes both ISCOM adjuvants, which are produced with an antigen and comprise antigen within the ISCOM particle and ISCOM matrix adjuvants, which hollow ISCOM-type adjuvants that are produced without antigen.

As used herein, the term "isolated" indicates a different form than found in nature. The different form of a protein (polypeptide) or nucleic acid can be, for example, a different purity than found in nature. In one embodiment, the term refers to proteins or nucleic acids, as dictated by the context, which are substantially or essentially free from components that normally accompany it in its native state.

As used herein, the term "derivative" refers to a polypeptide having one or more alterations, which can be changes in the amino acid sequence (including additions and deletions of amino acid residues) and/or chemical modifications, relative to a reference sequence (e.g., a TcdA, TcdB, CDTa or CDTb sequence described herein). In preferred embodiments, the derivative is at least 85%, at least 90%, at least 95%, at least 97%, at least 99% identical to the original reference sequence prior to alteration. In general, derivatives retain the activity of the reference sequence, e.g. inducing an immune response. As used herein, the term "derivative" is not limited to derivatives of a wild-type or native reference sequence, but includes derivatives of a mutant sequence as a reference sequence. In preferred embodiments, any specified mutations of the reference sequence are maintained, but alterations/modifications relative to the mutant reference sequence are included in the derivative sequence at amino acid residues other than the specified mutations of the reference sequence. As used herein, the term "derivative" also includes polynucleotides that have one or more alterations relative to a reference nucleotide sequence.

In one embodiment, a derivative is a polypeptide that has an amino acid sequence which differs from the base sequence from which it is derived by one or more amino acid substitutions. Amino acid substitutions may be "conservative" (i.e. the amino is replaced with a different amino acid from the same class of amino acids (non-polar, polar/neutral, acidic and basic), an amino acid with broadly similar properties, or with similar structure (aliphatic, hydroxyl or sulfur-containing, cyclic, aromatic, basic, and acidic)) or "non-conservative" (i.e. the amino acid is replaced with an amino acid of a different type). Broadly speaking, fewer non-conservative substitutions will be possible without altering the biological activity of the polypeptide. Some embodiments of the invention include derivatives that include no more than 25 amino acid residues, 20 amino acid residues, 15 amino acid residues, 12 amino acid residues, 11 amino acid residues, 10 amino acid residues, 9 amino acid residues, 8 amino acid residues, 7 amino acid residues, 6 amino acid residues, 5 amino acid residues, 4 amino acid residues, 3 amino acid residues, 2 amino acid residues, or 1 amino acid residue that is/are substituted relative to a reference sequence.

In another embodiment, a derivative is a polypeptide that has an amino acid sequence which differs from the base sequence from which it is derived by having one or more amino acid deletions and/or additions in any combination. Deleted or added amino acids can be either contiguous or individual residues. In some embodiments, no more than 25 amino acid residues, no more than 20 amino acid residues, no more than 15 amino acid residues, no more than 12 amino acid residues, no more than 10 amino acid residues, no more than 8 amino acid residues, no more than 7 amino acid residues, no more than 6 amino acid residues, no more than 5 amino acid residues, no more than 4 amino acid residues, no more than 3 amino acid residues, no more than 2 amino acid residues, or no more than 1 amino acid residue is/are deleted or added relative to a reference sequence.

In another embodiment, a derivative is a polypeptide that has an amino acid sequence which differs from the base sequence from which it is derived by having one or more chemical modifications of the protein. Chemical modifications include, but are not limited to, modification of functional groups (such as alkylation, hydroxylation, phosphatation, thiolation, carboxilation and the like), incorporation of unnatural amino acids and/or their derivatives during protein synthesis and the use of crosslinkers and other methods which impose conformational constraints on the polypeptides.

Any method known in the art can be used to determine the degree of difference between a reference sequence (e.g., SEQ ID NO:44 or 67) and a derivative. In one embodiment, sequence identity is used to determine relatedness. Derivatives of the invention will be at least 85% identical, at least 90% identical, at least 95% identical, at least 97% identical, at least 98% identical, at least 99% identical to the reference sequence (e.g., SEQ ID NO:44). The percent identity is defined as the number of identical residues divided by the total number of residues and multiplied by 100. If sequences in the alignment are of different lengths (due to gaps or extensions), the length of the longest sequence will be used in the calculation, representing the value for total length. Advantageously, relatedness of a sequence to a reference sequence can be determined for example, by comparing sequence information using sequence analysis software such as the GAP computer program, version 6.0, available from the University of Wisconsin Genetics Computer Group (UWGCG). The GAP program utilizes the alignment method of Needleman and Wunsch (*J. Mol. Biol.* 48:443, 1970), as revised by Smith and Waterman (*Adv. Appl. Math.* 2:482, 1981).

In additional embodiments, hybridization is used to determine relatedness. Nucleic acids encoding derivatives of the invention will hybridize to nucleic acids encoding a reference sequence under highly stringent conditions. Stringency of hybridization reactions is readily determinable by one of ordinary skill in the art, and generally is an empirical calculation dependent upon probe length, washing temperature, and salt concentration.

A "pharmaceutically-acceptable carrier" is meant to be a substance that facilitates administration. Examples include liquid fillers, diluent or other substances that may be safely used in systemic administration. Depending upon the particular route of administration, a variety of pharmaceutically acceptable carriers, well known in the art may be used. These carriers may be selected from a group including sugars, starches, cellulose and its derivatives, malt, gelatin, talc, calcium sulfate, vegetable oils, synthetic oils, polyols, alginic acid, phosphate buffered solutions including phosphate buffered saline, emulsifiers, isotonic saline, and pyrogen-free water. In particular, pharmaceutically acceptable carriers may contain different components such as a buffer, sterile water for injection, normal saline or phosphate-buffered saline, sucrose, histidine, salts and polysorbate. Terms such as "physiologically acceptable", "diluent" or "excipient" can be used interchangeably.

"PD" means "post-dose," and "PD1", "PD2", "PD3", etc. mean "post dose 1," "post-dose 2," "post-dose 3" etc.

BRIEF DESCRIPTION OF THE DRAWINGS

FIG. 2 shows a multiple sequence alignment of LCT from various *Clostridium* species highlighting the highly conserved residues lining the active site.

FIG. 3 provides the identity of the mutations of the recombinant TcdA (FIG. 3A) and TcdB (FIG. 3B) mutants (full length and enzyme domain) described in the Examples herein.

FIG. 6 shows the residual toxicity associated with various TcdA and TcdB constructs in a cell-based assay. Different mutant forms of both TcdA and TcdB containing either 3, 4, or 5 mutations (toxin A mutants: nap_3 mTcdA_bm, vpi_4mTcdA_bv, vpi_5mTcdA_bv and toxin B mutants: nap_3mTcdB_bm, nap_4mTcdB_ec, and nap_5mTcdB_bv) were compared to native toxin purified from *C. difficile* (vpi_TcdA_cd, nap_TcdA_cd, vpi_TcdB_cd, and nap_TcdB_cd) or with formaldehyde inactivated native toxin (vpi_ToxA_cd and vpi_ToxB_cd) or formaldehyde-inactivated mutant toxins (vpi_5mToxA_bv and nap_5mToxB_bm). An increase in TC50 indicates a reduction in toxin activity. The lower dashed line indicates a proposed safety threshold.

FIG. 8 shows an analysis of protection in a hamster challenge model. Shown is an evaluation of the ability of various mutant TcdA and TcdB toxins, listed at top, produced recombinantly in various expression systems to protect hamsters from a lethal challenge with *C. difficile* spores. Hamsters were challenged with the VPI strain, as described in Example 7. The source of the TcdA and TcdB mutants was as indicated (vpi or nap). Expression systems used for each mutant are also indicated (cd (*clostridium difficile*), by (baculovirus), bm (*Bacillus megaterium*) and ec (*E. coli*)).

FIG. 9 provides the amino acid sequence (SEQ ID NO: 26) of VPI_5mTcdA, which has the following mutations: W101A, D287A, E514Q, W519A, and C700A.

FIG. 10 provides the amino acid sequence (SEQ ID NO: 28) of NAP_5mTcdB, which has the following mutations: W102A, D288A, E515Q, W520A, and C698A.

FIG. 13 shows the amino acid sequences of CDTa minus the signal peptide from the native CDTa protein (panel A, SEQ ID NO:38); 3mCDTa1 (panel B, SEQ ID NO:40) and 3mCDTa2 (panel C, SEQ ID NO:42), as described, supra. Mutated residues in 3mCDTa1 and 3mCDTa2 are shown. CDTa sequences shown are from the NAP1 strain R20291.

FIG. 14 shows the amino acid sequence of proCDTb (panel A, SEQ ID NO:44), which lacks the CDTb signal peptide from the native CDTb protein; and CDTb (panel B, SEQ ID NO:46), which lacks both the signal peptide and the activation domain from the native CDTb protein. CDTb sequences shown are from the NAP1 strain R20291.

FIG. 15 shows the native amino acid sequence of CDTa from the R20291 reference strain (SEQ ID NO: 59). The signal peptide of native CDTa is underlined. The location of residue number 1, for purposes of numbering CDTa mutations herein, is shown. Residue no. 1 begins at the first amino acid following the signal peptide.

FIG. 16 provides an alignment of the N-terminal portion of native TcdA (SEQ ID NO:60) and native TcdB (SEQ ID NO:61) from *C. difficile* VPI10463 strain from residue 1 to residue 719 (TcdA) and 717 (TcdB). Locations of mutations disclosed herein are underlined; however, residues shown are from the native sequences.

FIG. 17 provides a summary of the protocol for rhesus monkey "Study #11" (see Example 12). Each group received vpi_5mTcdA_bv, nap_5mTcdB_bv, 3m_CdtA2_bv and proCdtB_bv intramuscularly at the indicated dosing schedule. In addition to the toxin vaccine components, each group received an adjuvant or adjuvant combination (IMO=IMO2170, MAA=aluminum hydroxyphosphate sulfate; and IMX=ISCOMATRIX® (CSL Ltd.)) in the indicated amount or no adjuvant as shown. Some vaccine compositions were treated with formaldehyde as indicated.

FIGS. 19A-19C provide neutralization assay data for TcdA, TcdB, and binary toxin, respectively. For FIGS. A and B, bars shown for each dose from left to right correspond to groups 1-11. Nab assays were utilized to measure the ability of antisera to inhibit killing of Vero cells by native TcdA or TcdB. Neutralizing antibody titers to TcdA and TcdB are provided at day 0, day 7/10, day 30, and day 45 (FIGS. A and B), for the groups in Study 11 and at day 45 for binary toxin (FIG. C).

FIG. 20C provides the results of SEC MALS analysis of 4mCDTa8. Results provided show molar mass over time. A single monomer peak is visible for 4mCDTa8.

DETAILED DESCRIPTION OF THE INVENTION

The invention includes recombinant TcdA and TcdB mutant toxins and vaccines and immunogenic compositions comprising said toxins, which comprise specific mutations that significantly reduce or eliminate toxin enzymatic activity and are effective at providing protection against challenge with *C. difficile* spores from a prototypic *C. difficile* strain in a hamster challenge model. Because TcdA and TcdB are the sole causative agents of CDI, these toxins are desirable targets for the prevention and/or treatment of this disease. Vaccination of subjects with these toxins could potentially induce the production of protective antibodies that would neutralize the toxic effect of these molecules in the subject. Vaccination with these toxins, however, is not safe for human patient populations unless the toxicity associated with the proteins is eliminated or drastically reduced. Applicants have identified mutations and combinations thereof that significantly decrease and preferably eliminate toxicity, and at the same time, toxins containing these mutations retain the ability to induce immunogenicity.

The invention also includes recombinant CDTa and CDTb toxin proteins and vaccines and immunogenic compositions comprising said toxins, in combination with mutant TcdA and TcdB, wherein the CDTa toxin protein comprises specific mutations that significantly reduce or eliminate toxin enzymatic activity. Vaccines and compositions comprising said CDTa and CDTb toxin proteins as described herein are effective at providing protection against challenge with *C. difficile* spores from an epidemic *C. difficile* strain in a hamster challenge model (see EXAMPLE 11).

Figure 1:
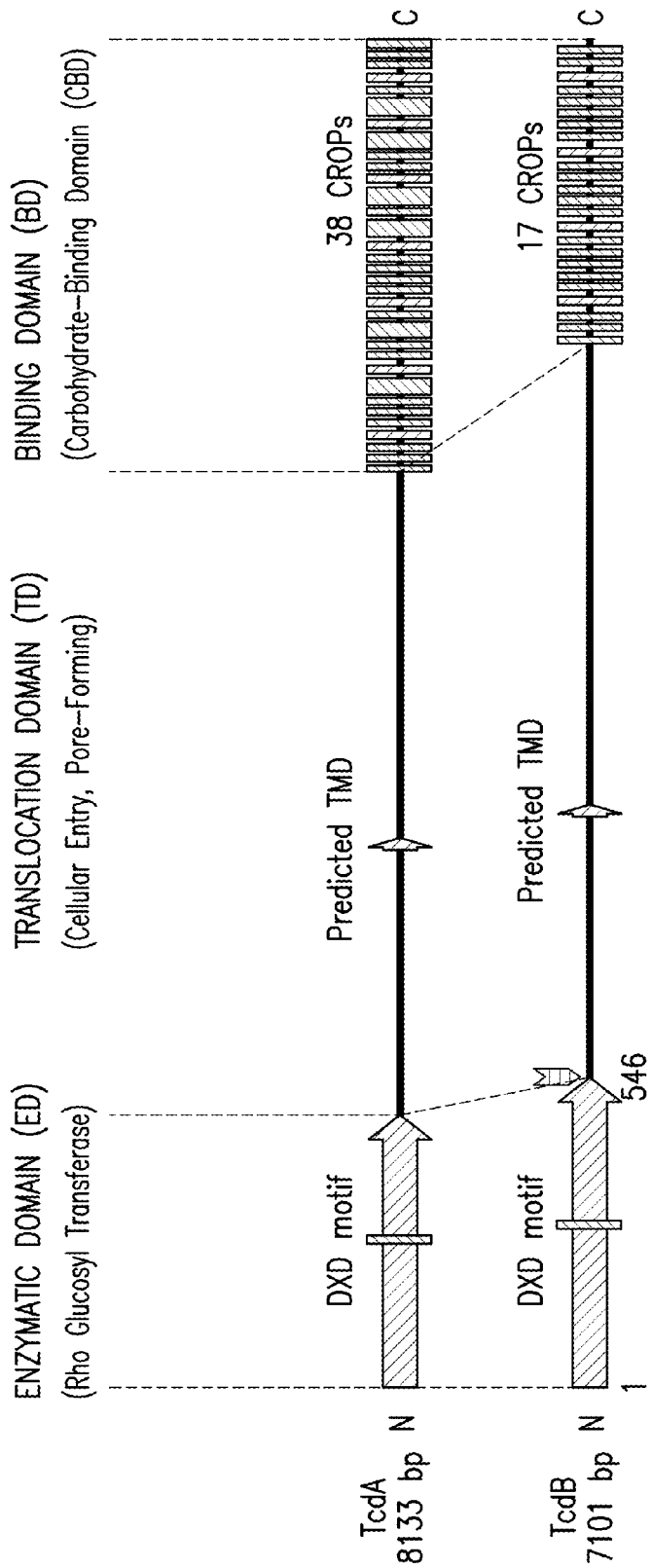
FIG. 1 shows the structure of the large clostridial toxins from *Clostridium difficile* toxin A and B (TcdA and TcdB).

Structurally, TcdA and TcdB are comprised of an enzymatic domain (ED) at the N-terminus, a cysteine protease domain (CPD), a translocation domain (TD), and a binding domain at the C-terminus (BD) (see FIG. 1). The ED inactivates small Rho GTPases, resulting in dramatic and irreversible alteration in the cellular cytoskeleton and ultimately leads to the demise of the affected cell through apoptosis (Gerhard et al., *Journal of Medical Microbiology*, 57: 765-770 (2008); Spyres et al., *Infection and Immunity* 71(6): 3294-3301 (2003), Busch et al., *J. Biol. Chem.* 273(31): 19566-19572 (1998)). The CPD is responsible for the auto-catalytic cleavage of the ED. The TD mediates the translocation of the ED into the cytoplasm following binding of the BD to the cell surface. Translocation is dependent on the endocytic pathway, whereby the TD is believed to change its conformation upon acidification of the late endosome and create a pore allowing entry into the cytoplasm of the ED. The BD is a multivalent, repetitive receptor binding domain comprised of clostridial repetitive oligo peptides (CROPs). The CROPS bind to surface carbohydrates (e.g. Lewis$^X$ and Lewis$^Y$) and mediate attachment and endocytosis of the toxin. These repeats are highly immunogenic and have been a target for vaccines against *C. difficile*.

Figure 2A:
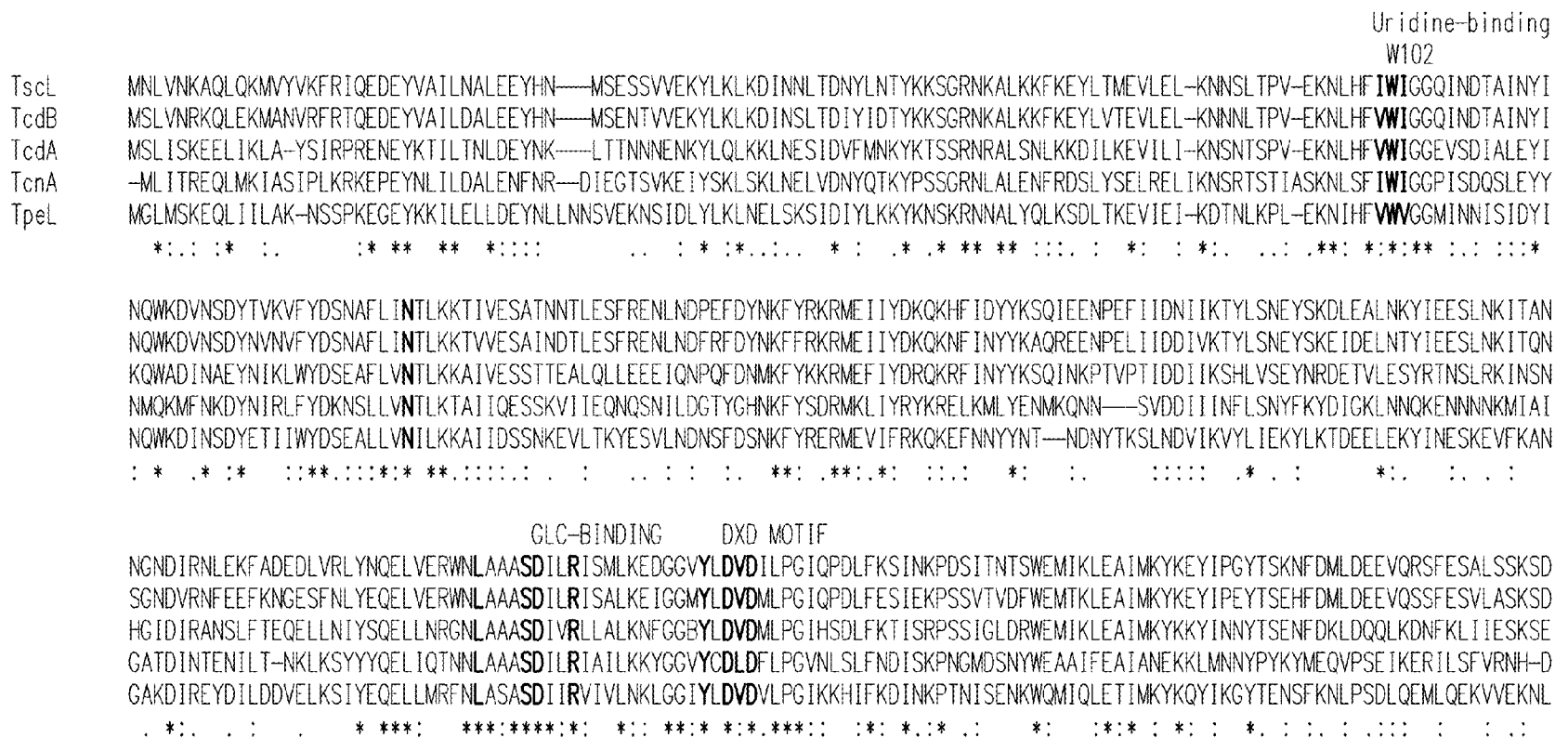

The LCT family currently comprises 5 members: TcdA, TcdB (*Clostridium difficile*), TcnA (*Clostridium novyi*), TcsL (*Clostridium sordellii*) and TpeL (*Clostridium perfringens*). These toxins share a similar organization, substrates (RhoA GTPases), cosubstrates (UPD-Glucose, UDP-NAcGlucosamine) and cofactors (MnII). Their mutual sequence identities range from 29-76%, yet the catalytic residues and the residues lining the active site of the enzyme domains are almost 100% conserved (see FIG. 2), underpinning mechanistic unity. The enzyme domains of TcsL, TcnA and TcdB have been crystallized (Reinert et al., *J. Mol. Biol.* 351: 973-81 (200); Ziegler et al., *J. Mol. Biol.* 377: 1346-56 (2007)) and their structure is almost identical. Additionally, the crystal structure of the enzyme domain of TcdA was recently published (Pruitt et al., *J. Biol. Chem.* 287: 8013-8020 (2012)). It was shown that TcdA does indeed have a similar structure to other LCT family members. Specifically, the structures of the cores of the toxins (UDP binding and catalytic activity) are conserved compared to TcdA, but the surfaces are divergent.

In general, toxin mutagenesis has been described. In particular, a number of studies describe research related to the tryptophan residue at position 102 (W102) and the catalytic triad motif DXD which is a signature motif of the glycosyltransferase A family, of which LCTs are part. The first description of the W102A mutation was by Busch et al. (*J Biol. Chem.* 275(18): 13228-234 (2000)), which focused on the catalytic domain of TcsL. In that study, it was observed that W102A decreased glycosylation activity about 1,000 fold and W102Y reduced activity 100 fold when compared to the wild type fragment suggesting that aromatic stacking of the uracil ring was a likely function of this residue. Busch et al. briefly mention a *Clostridium difficile* rTcdB W102A fragment which was found to be much less active in a glucosylation assay compared to the wild type fragment. The authors conclude that this reduction in enzymatic activity is due to a decrease in binding affinity for the cosubstrate. Teichert et al. (*Infect and Immun.* 74: 6006-6010 (2006)) disclose that the W101A mutation in recombinant, full length TcdA reduces glucosyltransferase activity by 380-fold in an in vitro system (RhoA-glucosylation, see below) and cytopathic activity on Swiss 3T3 fibroblasts by 50-fold. Increasing the concentration of the mutant toxin 50-fold restored full cytotoxicity. Finally, Gerhard et al (*Journal of Medical Microbiology* 57, 765-770 (2008)) examined the apoptotic effect of a full length W101A TcdA mutant. Wild type TcdA is able to induce apoptosis at 1 nM concentration while cells treated with the W101A mutant exhibit only minimal signs of apoptosis. However, when the concentration of TcdA W101A mutant is increased 50 fold, cells did exhibit similar levels of apoptosis to wild type. Mutagenesis of toxin B was also described by Jank et al., (*J. Biol. Chem.* 282(48): 35222-35231 (2007)) and Barroso et al. (*Microbial Pathogenesis* 16: 297-303 (1994)). Specific mutant toxins are also described by Sidhu et al. (U.S. Patent Application Publication No. 2012/0269841).

The DXD motif is essential for enzymatic activity as it is involved in MnII, UDP and glucose binding, orientation and polarization. The D288 residue binds directly to MnII. D286 interacts with the general base (e.g. the water molecule that hydrolyzes the cosubstrate), UDP and glucose. Busch et al. (*Journal of Biological Chemistry* 273: 18566-19572 (1998)) describe mutations to this site in catalytic domain fragments of TcsL. It was found that exchanging the aspartic acid at positions 286 or 288 with alanine or asparagine decrease glucosylation activity about 5,000 fold in an in vitro assay (Busch et al, 1998, supra). No enzymatic activity was observed with the D286A/D288A double mutant. Similar inhibition for *C. difficile* TcdB fragments was observed when the aspartic acid residues in the DXD motif were changed to alanine. Additionally, it was disclosed that in the presence of high concentrations of MnII, the activity of the TcsL D288A enzyme was increased about 20 fold, still resulting in a several hundred fold reduction in activity (Busch et al, 1998, supra). High MnII concentrations did not modulate the activity of the double mutant. Teichert et al. (2006) observed a comparable 6,900 fold decrease in in vitro activity with full length D285/287N double mutants compared to wild type TcdA. Finally, Gerhard et al. (*Journal of Medical Microbiology* 57: 765-770 (2008)) demonstrated that a TcdA D285A/D287A double mutant was unable to induce apoptosis.

Without wishing to be bound by theory, based on close examination of the active site of LCT, we hypothesized that removing the large aromatic ring at position 102 (W102A) would result in a net loss of binding energy for the UDP ring of the cosubstrate (by aromatic stacking), resulting in an enzyme with lower catalytic turnover. This is only partly restored by replacing the alanine with a tyrosine at that position because the phenolic ring of tyrosine is much smaller than the indolic double ring of tryptophan and therefore affords less binding energy. Mutations of either or both aspartic residues in the DXD motif have profound effect on the enzymatic activity of LCT, as the active site is lacking critical residues involved in binding of the MnII cofactor and polarization and ultimately hydrolysis of the O-glycosidic bond in UDP-glucose. It was thus reasoned that combining mutations in the W102/101 pocket and DXD motif would result in enzymes that will exhibit only a fraction of the wild type activity, as they would be severely impaired in their ability to bind and polarize the cosubstrate.

Full length genetically inactive TcdA and TcdB and expression thereof in *Bacillus megaterium* was described in WO 2011/068953. Specifically, WO2011/068953 describes mutant TcdA, comprising the mutations W101A, D287N and W519A and mutant TcdB comprising the mutations W102A and D288N. These toxins were evaluated in mice, but it is unclear whether the animals were evaluated for adverse events following vaccination.

We have found that a vaccine consisting of TcdA and TcdB, each containing three mutations, (3mTcdA; W101A, D287A, E514Q) and (3mTcdB; W102A, D288A, E515Q) resulted in unacceptable toxicity (local inflammation and swelling) in hamsters and monkeys unless this vaccine was further formaldehyde inactivated. In an attempt to further lower toxicity, three additional mutations were separately introduced into the catalytic domain of TcdA and TcdB from strain VPI10463, as described herein and shown in FIGS. 3A and 3B. Specifically, a mutation to the isosteric binding of site MnII at position E514/515 (TcdA/TcdB) and mutations at positions S517/518 and W519/520 (TcdA/TcdB) which affect the polarization of the 0-glycosidic bond were tested. Additionally a single amino acid deletion mutant was also constructed and expressed in E. coli.

Figure 5:
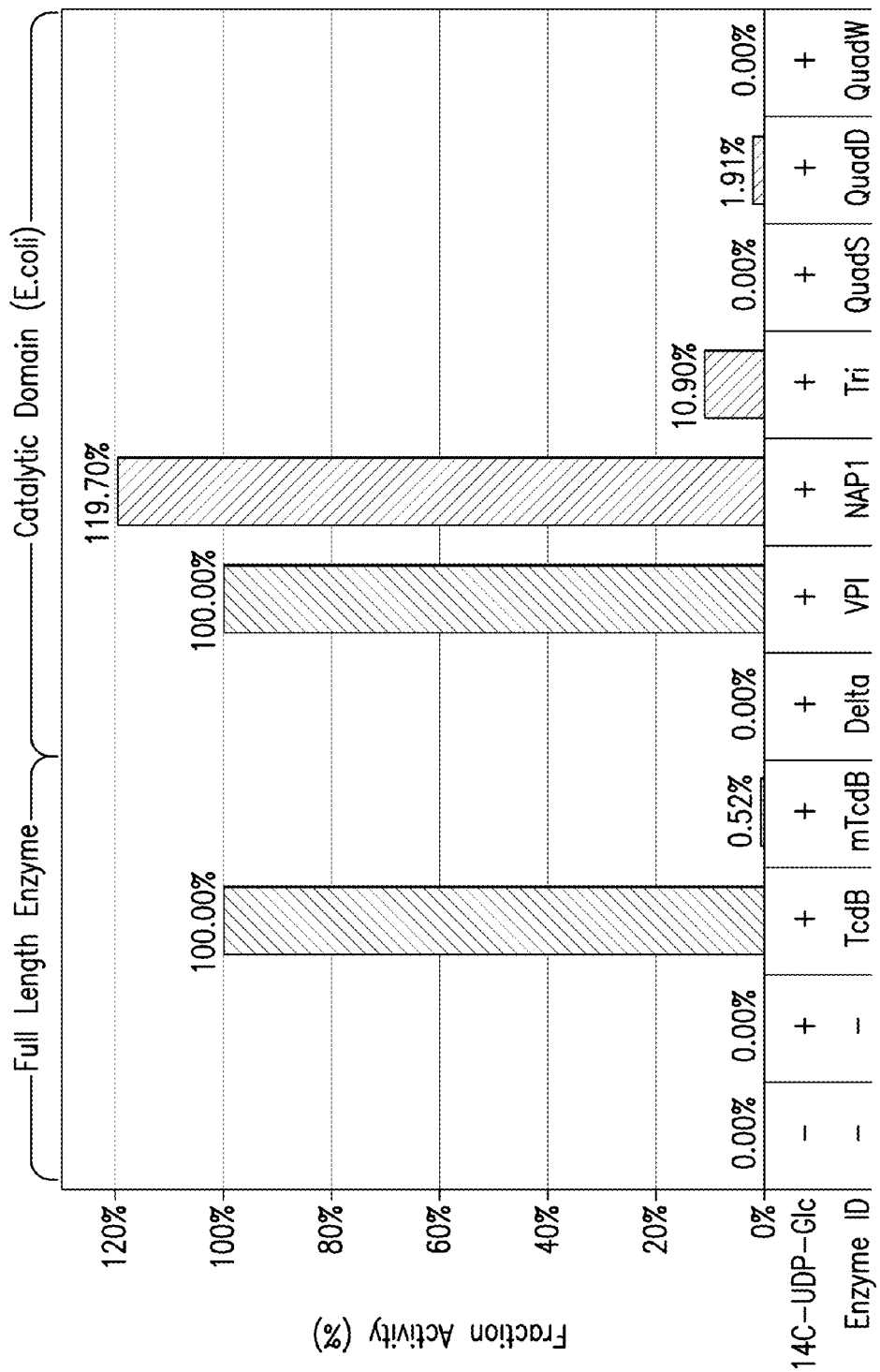
FIG. 5 shows results from a RhoA Glucosylation assay for TcdB and mutant recombinant enzyme domains, as described in Example 2. Data were normalized to VPI10463 TcdB having 100% activity. Data are shown for native full length TcdB toxin (TcdB), and full-length 3mTcdB expressed in *B. megaterium* (mTcdB). Also shown are data for the following catalytic domain fragments: W102 deletion (Delta), wild type VPI10463 TcdB (VPI), wild type TcdB (NAP1), triple mutant W102A, D288A, E515Q (Tri), quadruple mutant W102A, D288A, E515Q, S518A (QuadS), quadruple mutant W102A, D286A, D288A, E515Q (QuadD), and quadruple mutant W102A, D288A, E515Q, W520A (Quad W). All mutant fragments were derived from the VPI1-463 strain.

As shown in FIG. 5 and Example 2 herein, no residual enzyme activity was apparent for 4mTcdB when analyzed using a RhoA Glucosylation assay. Despite the addition of this fourth mutation, residual toxicity was still observed following immunization of animals. Therefore, a fifth mutation, C700A/698A, was introduced, which is the key residue of the cysteine protease responsible for cleaving the catalytic domain from the translocation domain allowing its release into the cytoplasm. The introduction of this mutation lead to an additional ten fold decrease in toxicity of TcdB.

Mutant TcdA and TcdB Toxoids

As discussed above, experiments described herein show that C. difficile mutant toxins comprising 3, 4, or 5 mutations lead to a decrease in toxicity of the proteins, to differing levels. To that end, the invention relates, in part, to an isolated and/or purified recombinant TcdA protein comprising at least 3 mutations designed to eliminate toxicity of the protein. It further relates to an isolated and/or purified recombinant TcdB protein comprising at least 3 mutations designed to eliminate toxicity of the protein. In preferred embodiments of the invention, the recombinant TcdA and TcdB proteins of the invention comprise at least 4 mutations or at least 5 mutations designed to eliminate toxicity. Tcd proteins comprising at least 3 mutations may be further detoxified through chemical means, e.g. formaldehyde inactivated.

In embodiments of the invention, the TcdA mutants comprise a C. difficile toxin A protein (TcdA) which comprises or consists of at least 3, at least 4, or at least 5 mutations at amino acid residues selected from the group consisting of: W101, D287, E514, D285, S517, W519, and C700. In additional embodiments; the TcdA mutants comprise or consist of at least 3, at least 4, or at least 5 mutations selected from the group consisting of: W101A, D287A, E514Q, D285A, S517A, W519A, and C700A substitutions and a W101 deletion.

Native C. difficile toxin A protein sequences, which serve as the basis for introduction of mutations, can be from any C. difficile strain, e.g. NAP1/027/BI ("NAP") or VPI 10463. In preferred embodiments of the invention, the TcdA mutant comprises a sequence of amino acids that was obtained from the VPI 10463 strain. Exemplary TcdA amino acid sequences that can form the backbone of the TcdA mutant sequences herein (i.e. mutations specified herein may be made to the reference "backbone" sequences at the specified positions) include the amino acid sequences set forth in SEQ ID NO:94 (VPI10463 strain, Genbank Accession no. CAA63564); SEQ ID NO:95 (strain 630 (toxinotype 0, ribotype 012)), SEQ ID NO:96 (SE844 (toxinotype IIIa, ribotype 080)), SEQ ID NO:97 (R12087 (NAP1)), SEQ ID NO:98 (K14 (toxinotype 0, ribotype 053)), SEQ ID NO:99 (BI6 (NAP1)), SEQ ID NO:100 (BI17 (NAP1)), SEQ ID NO:101 (CH6230 (toxinotype IIIc)), and SEQ ID NO:102 (SE881 (toxinotype V, ribotype 066)). Also included within the scope of the invention are derivatives of the mutant TcdA proteins that retain the mutations of a mutant reference sequence. For example, a derivative of a mutant TcdA protein derived from the VPI reference strain, which comprises or consists of a W101A substitution, would maintain the W101A substitution, but may include alterations/modifications to the VPI amino acid reference sequence at other positions.

A specific embodiment of the invention provides a TcdA protein comprising or consisting of the amino acid substitutions W101, D287A, and E514Q. A further embodiment provides a TcdA protein comprising or consisting of the amino acid substitutions W101A, D287A, E514Q, and W519A. Another specific embodiment of the invention is a TcdA protein comprising or consisting of the amino acid substitutions W101A, D287A, E514Q, W519A, and C700A.

In alternative embodiments of the invention described herein, the TcdA protein comprises or consists of the mutations W101A, D287A, E514Q and D285A. Another alternative embodiment provides a TcdA protein comprising or consisting of the mutations W101A, D287A, E514Q and S517A. In any of these alternative embodiments or any other embodiments described herein, a further mutation may be added to the TcdA protein, e.g. a C700A mutation. In additional embodiments of the invention, up to 2, 3, 4, 5, 6, 7, 8, 9, 10, 11, 12, 13, 14, 15, 16, 17, 18, 19, or 20 further mutations may be added to any of the TcdA embodiments described herein.

In specific embodiments of the invention, the mutant TcdA protein comprises, consists, or consists essentially of a sequence of amino acids as set forth in SEQ ID NO:7, SEQ ID NO:8, SEQ ID NO:9, SEQ ID NO:10, SEQ ID NO:11, SEQ ID NO:12, SEQ ID NO:25, or SEQ ID NO:35.

In alternative embodiments of the invention, the TcdA protein comprises, consists, or consists essentially of mutations at any amino acid residue position described herein (i.e. W101, D287, E514, D285, S517, W519, and C700), wherein the specified amino acid residue is substituted with any other amino acid residue not present in a native sequence, e.g. the tryptophan at position 101 is substituted with any residue but tryptophan, the aspartic acid at position 287 is replaced with any amino acid residue but aspartic acid. For example, an alternative embodiment of the invention includes a variant of the TcdA sequence defined by SEQ ID NO:26 (5mTcdA: W101A, D287A, E514Q, W519A, C700A) which comprises or consists of mutations at positions W101, D287, E514, W519 and C700; wherein W101 is replaced with any amino acid except tryptophan, D287 is replaced with any amino acid but aspartic acid, E514 is replaced with any amino acid but glutamic acid, W519 is replaced with any amino acid but tryptophan and C700 is replaced with any amino acid but cysteine, as set forth in SEQ ID NO:70.

In preferred embodiments, the described amino acid residues (W101, D287, E514, D285, S517, W519, and C700) are substituted with amino acid residues that are similar in structure or in the same class as the mutations defined by W101A, D287A, E514Q, D285A, S517A, W519A, and C700A. For example, in preferred embodiments, the tryptophan at position 101 is replaced with an amino acid that in the same class or that has a similar structure to alanine.

In additional embodiments of the invention, the mutant TcdA protein comprises, consists, or consists essentially of the amino acid sequence shown below:

(SEQ ID NO: 26)
MSLISKEELIKLAYSIRPRENEYKTILTNLDEYNKLTTNNNENKYLQLKK

LNESIDVFMNKYKTSSRNRALSNLKKDILKEVILIKNSNTSPVEKNLHFV

-continued

```
AIGGEVSDIALEYIKQWADINAEYNIKLWYDSEAFLVNTLKKAIVESSTT
EALQLLEEEIQNPQFDNMKFYKKRMEFIYDRQKRFINYYKSQINKPTVPT
IDDIIKSHLVSEYNRDETVLESYRTNSLRKINSNHGIDIRANSLFTEQEL
LNIYSQELLNRGNLAAASDIVRLLALKNFGGVYLDVAMLPGIHSDLFKTI
SRPSSIGLDRWEMIKLEAIMKYKKYINNYTSENFDKLDQQLKDNFKLIIE
SKSEKSEIFSKLENLNVSDLEIKIAFALGSVINQALISKQGSYLTNLVIE
QVKNRYQFLNQHLNPAIESDNNFTDTTKIFHDSLFNSATAENSMFLTKIA
PYLQVGFMPEARSTISLSGPGAYASAYYDFINLQENTIEKTLKASDLIEF
KFPENNLSQLTEQQINSLASFDQASAKYQFEKYVRDYTGGSLSEDNGVDF
NKNTALDKNYLLNNKIPSNNVEEAGSKNYVHYIIQLQGDDISYEATCNLF
SKNPKNSIIIQRNMNESAKSYFLSDDGESILELNKYRIPERLKNKEKVKV
TFIGHGKDEFNTSEFARLSVDSLSNEISSFLDTIKLDISPKNVEVNLLGA
NMFSYDFNVEETYPGKLLLSIMDKITSTLPDVNKNSITIGANQYEVRINS
EGRKELLAHSGKWINKEEAIMSDLSSKEYIFFDSIDNKLKAKSKNIPGLA
SISEDIKTLLLDASVSPDTKFILNNLKLNIESSIGDYIYYEKLEPVKNII
HNSIDDLIDEFNLLENVSDELYELKKLNNLDEKYLISFEDISKNNSTYSV
RFINKSNGESVYVETEKEIFSKYSEHITKEISTIKNSIITDVNGNLLDNI
QLDHTSQVNTLNAAFFIQSLIDYSSNKDVLNDLSTSVKVQLYAQLFSTGL
NTIYDSIQLVNLISNAVNDTINVLPTITEGIPIVSTILDGINLGAAIKEL
LDEHDPLLKKELEAKVGVLAINMSLSIAATVASIVGIGAEVTIFLLPIAG
ISAGIPSLVNNELILHDKATSVVNYFNHLSESKKYGPLKTEDDKILVPID
DLVISEIDFNNNSIKLGTCNILAMEGGSGHTVTGNIDHFFSSPSISSHIP
SLSIYSAIGIETENLDFSKKIMMLPNAPSRVFWWETGAVPGLRSLENDGT
RLLDSIRDLYPGKFYWRFYAFFDYAITTLKPVYEDTNIKIKLDKDTRNFI
MPTITTNEIRNKLSYSFDGAGGTYSLLLSSYPISTNINLSKDDLWIFNID
NEVREISIENGTIKKGKLIKDVLSKIDINKNKLIIGNQTIDFSGDIDNKD
RYIFLTCELDDKISLIIEINLVAKSYSLLLSGDKNYLISNLSNTIEKINT
LGLDSKNIAYNYTDESNNKYFGAISKTSQKSIIHYKKDSKNILEFYNDST
LEFNSKDFIAEDINVFMKDDINTITGKYYVDNNTDKSIDFSISLVSKNQV
KVNGLYLNESVYSSYLDFVKNSDGHHNTSNFMNLFLDNISFWKLFGFENI
NFVIDKYFTLVGKTNLGYVEFICDNNKNIDIYFGEWKTSSSKSTIFSGNG
RNVVVEPIYNPDTGEDISTSLDFSYEPLYGIDRYINKVLIAPDLYTSLIN
INTNYYSNEYYPEIIVLNPNTFHKKVNINLDSSSFEYKWSTEGSDFILVR
YLEESNKKILQKIRIKGILSNTQSFNKMSIDFKDIKKLSLGYIMSNPFKSF
NSENELDRDHLGFKIIDNKTYYYDEDSKLVKGLININNSLFYFDPIEFNL
VTGWQTINGKKYYFDINTGAALTSYKIINGKHFYFNNDGVMQLGVFKGPD
GFEYFAPANTQNNNIEGQAIVYQSKFLTLNGKKYYFDNNSKAVTGWRIIN
NEKYYFNPNNAIAAVGLQVIDNNKYYFNPDTAIISKGWQTVNGSRYYFDT
DTAIAFNGYKTIDGKHFYFDSDCVVKIGVFSTSNGFEYFAPANTYNNNIE
GQAIVYQSKFLTLNGKKYYFDNNSKAVTGLQTIDSKKYYFNTNTAEAATG
WQTIDGKKYYFNTNTAEAATGWQTIDGKKYYFNTNTAIASTGYTIINGKH
```

-continued

```
FYFNTDGIMQIGVFKGPNGFEYFAPANTDANNIEGQAILYQNEFLTLNGK
KYYFGSDSKAVTGWRIINNKKYYFNPNNNAIAAIHLCTINNDKYYFSYDGI
LQNGYITIERNNFYFDANNESKMVTGVFKGPNGFEYFAPANTHNNNIEGQ
AIVYQNKFLTLNGKKYYFDNDSKAVTGWQTIDGKKYYFNLNTAEAATGWQ
TIDGKKYYFNLNTAEAATGWQTIDGKKYYFNTNTFIASTGYTSINGKHFY
FNTDGIMQIGVFKGPNGFEYFAPANTDANNIEGQAILYQNKFLTLNGKKY
YFGSDSKAVTGLRTIDGKKYYFNTNTAVAVTGWQTINGKKYYFNTNTSIA
STGYTIISGKHFYFNTDGIMQIGVFKGPDGFEYFAPANTDANNIEGQAIR
YQNRFLYLHDNIYYFGNNSKAATGWVTIDGNRYYFEPNTAMGANGYKTID
NKNFYFRNGLPQIGVFKGSNGFEYFAPANTDANNIEGQAIRYQNRFLHLL
GKIYYFGNNSKAVTGWQTINGKVYYFMPDTAMAAAGGLFEIDGVIYFFGV
DGVKAPGIYG*
```

In additional embodiments, the mutant TcdA protein is a derivative of the TcdA proteins described herein, e.g. a derivative of the TcdA proteins comprising an amino acid sequence as set forth in SEQ ID NO:7, SEQ ID NO:8, SEQ ID NO:9, SEQ ID NO:10, SEQ ID NO:11, SEQ ID NO:12, SEQ ID NO:25, SEQ ID NO:26, SEQ ID NO:35, or SEQ ID NO:70. Such derivatives comprise amino acid sequences that are at least 85%, at least 90%, at least 95%, at least 97%, at least 98%, or at least 99% identical to the original reference sequence (e.g. SEQ ID NO:7, SEQ ID NO:8, SEQ ID NO:9, SEQ ID NO:10, SEQ ID NO:11, SEQ ID NO:12, SEQ ID NO:25, SEQ ID NO:26, SEQ ID NO:35 or SEQ ID NO:70). In a further embodiment, the invention includes TcdA protein derivatives that comprise modifications/alterations (e.g. substitutions) to no more than 12 amino acid residues, no more than 11 amino acid residues, no more than 10 amino acid residues, no more than 9 amino acid residues, no more than 8 amino acid residues, no more than 7 amino acid residues, no more than 6 amino acid residues, no more than 5 amino acid residues, no more than 4 amino acid residues, no more than 3 amino acid residues, no more than 2 amino acid residues, or 1 amino acid residue relative to SEQ ID NO:7, SEQ ID NO:8, SEQ ID NO:9, SEQ ID NO:10, SEQ ID NO:11, SEQ ID NO:12, SEQ ID NO:25, SEQ ID NO:26, SEQ ID NO:35 and SEQ ID NO:70.

The invention also relates to TcdB mutants that comprise a *C. difficile* toxin B protein which comprises or consists of at least 3, at least 4, or at least 5 mutations at amino acid residues selected from the group consisting of: W102, D288, E515, D286, S518, W520, and C698. In embodiments of the invention, the TcdB mutant proteins comprise or consist of at least 3, at least 4, or at least 5 mutations selected from the group consisting of: W102A, D288A, E515Q, D286A, S518A, W520A, and C698A substitutions and a W102 deletion.

Native *C. difficile* toxin B protein sequences, which serve as the basis for introduction of mutations, can be from any *C. difficile* strain, e.g. NAP1/027/BI ("NAP") strain or VPI 10463 strain. Exemplary TcdB amino acid sequences that can form the backbone of the TcdB mutant sequences herein (i.e. mutations specified herein may be made to the reference "backbone" sequences at the specified positions) include the sequences set forth in SEQ ID NO:86 (QCD-63q42 (ribotype 001, NAP2), NCBI Reference Sequence: ZP_05328744.10); SEQ ID NO:87 (NAP8, NCBI Reference Sequence: ZP_06891228.1), SEQ ID NO:88 (QCD-23m63 (ribotype 078, toxinotype V), NCBI Reference Sequence:

ZP_05400113.1), SEQ ID NO:89 (CD196 (NAP1, 027, toxinotype III), NCBI Reference Sequence: YP_003213639.1); SEQ ID NO:90 (1470 (ribotype 017, toxinotype VIII), GenBank Accession No.: CAA80815.1), SEQ ID NO:91 (8864 (ribotype 036, toxinotype X), GenBank Accession No.: CAC19891.1), SEQ ID NO:92 (5340, GenBank Accession No: AAG18011.1), and SEQ ID NO:93 (VPI10463 (ribotype 087, toxinotype 0), NCBI Reference Sequence: ZP_05349824.1). One skilled in the art will be able to introduce the desired mutations at the specified positions in any *C. difficile* strain.

In one embodiment of the invention, the TcdB mutant protein comprises a sequence of amino acids that is obtained from the NAP1 strain (e.g. a TcdB mutant protein 5mTcdB comprising, consisting, or consisting essentially of the amino acid sequence set forth in SEQ ID NO:28). In alternative embodiments, the TcdB mutant protein comprises a sequence of amino acids that is obtained from the VPI strain (e.g. a TcdB mutant protein 5mTcdB comprising, consisting, or consisting essentially of the amino acid sequence set forth in SEQ ID NO:58). Also included within the scope of the invention are derivatives of the mutant TcdB proteins that retain the mutations of a mutant reference sequence. For example, a derivative of a mutant TcdB protein derived from the NAP1 reference strain, which comprises or consists of a W102A substitution, would maintain the W102A substitution, but may include alterations/modifications to the NAP1 amino acid reference sequence at other positions.

A specific embodiment of the invention provides a TcdB protein comprising or consisting of the amino acid substitutions W102A, D288A, and E515Q. A further embodiment provides a TcdB protein comprising or consisting of the amino acid substitutions W102A, D288A, E515Q, and W520A. Another specific embodiment of the invention is a TcdB protein comprising or consisting of the amino acid substitutions W102A, D288A, E515Q, W520A, and C698A.

In alternative embodiments of the invention described herein, the TcdB protein comprises or consists of the mutations W102A, D288A, E515Q and D286A. Another alternative embodiment provides a TcdB protein comprising or consisting of the mutations W102A, D288A, E515Q and S518A. In any of these alternative embodiments, or any other embodiment of TcdB described herein, a further mutation may be added to the TcdB protein, e.g. a C698A mutation. In additional embodiments of the invention, up to 2, 3, 4, 5, 6, 7, 8, 9, 10, 11, 12, 13, 14, 15, 16, 17, 18, 19, or 20 further mutations may be added to any of the TcdB embodiments described herein.

In specific embodiments of the invention, the mutant TcdB protein comprises, consists, or consists essentially of a sequence of amino acids as set forth in SEQ ID NO:19, SEQ ID NO:20, SEQ ID NO:21, SEQ ID NO:22, SEQ ID NO:23, SEQ ID NO:24, SEQ ID NO:27, SEQ ID NO:28, or SEQ ID NO:58.

In additional embodiments of the invention, the mutant TcdB protein comprises, consists, or consists essentially of a sequence of amino acids as shown below:

(SEQ ID NO: 28)
MSLVNRKQLEKMANVRFRVQEDEYVAILDALEEYHNMSENTVVEKYLKLK

DINSLTDIYIDTYKKSGRNKALKKFKEYLVTEVLELKNNNLTPVEKNLHF

VAIGGQINDTAINYINQWKDVNSDYNVNVFYDSNAFLINTLKKTIVESAT

NDTLESFRENLNDPRFDYNKFYRKRMEIIYDKQKNFINYYKTQREENPDL

IIDDIVKIYLSNEYSKDIDELNSYIEESLNKVTENSGNDVRNFEEFKGGE

SFKLYEQELVERWNLAAASDILRISALKEVGGVYLDVAMLPGIQPDLFES

IEKPSSVTVDFWEMVKLEAIMKYKEYIPGYTSEHFDMLDEEVQSSFESVL

ASKSDKSEIFSSLGDMEASPLEVKIAFNSKGIINQGLISVKDSYCSNLIV

KQIENRYKILNNSLNPAISEDNDFNTTTNAFIDSIMAEANADNGRFMMEL

GKYLRVGFFPDVKTTINLSGPEAYAAAYQDLLMFKEGSMNIHLIEADLRN

FEISKTNISQSTEQQMASLASFDDARAKAQFEEYKKNYFEGSLGEDDNLD

FSQNTVVDKEYLLEKISSLARSSERGYIHYIVQLQGDKISYEAACNLFAK

TPYDSVLFQKNIEDSEIAYYYNPGDGEIQEIDKYKIPSIISDRPKIKLTF

IGHGKDEFNTDIFAGLDVDSLSTEIETAIDLAKEDISPKSIEINLLGANM

FSYSVNVEETYPGKLLLRVKDKVSELMPSISQDSIIVSANQYEVRINSEG

RRELLDHSGEWINKEESIIKDISSKEYISFNPKENKIIVKSKNLPELSTL

LQEIRNNSNSSDIELEEKVMLAECEINVISNIDTQVVEGRIEEAKSLTSD

SINYIKNEFKLIESISDALYDLKQQNELEESHFISFEDILETDEGFSIRF

IDKETGESIFVETEKAIFSEYANHITEEISKIKGTIFDTVNGKLVKKVNL

DATHEVNTLNAAFFIQSLIEYNSSKESLSNLSVAMKVQVYAQLFSTGLNT

ITDAAKVVELVSTALDETIDLLPTLSEGLPVIATIIDGVSLGAAIKELSE

TSDPLLRQEIEAKIGIMAVNLTAATTAIITSSLGIASGFSILLVPLAGIS

AGIPSLVNNELILRDKATKVVDYFSHISLAESEGAFTSLDDKIMMPQDDL

VISEIDFNNNSITLGKCEIWRMEGGSGHTVTDDIDHFFSAPSITYREPHL

SIYDVLEVQKEELDLSKDLMVLPNAPNRVFAWETGWTPGLRSLENDGTKL

LDRIRDNYEGEFYWRYFAFIADALITTLKPRYEDTNIRINLDSNTRSFIV

PVITTEYIREKLSYSFYGSGGTYALSLSQYNMNINIELNENDTWVIDVDN

VVRDVTIESDKIKKGDLIENILSKLSIEDNKIILDNHEINFSGTLNGGNG

FVSLTFSILEGINAVIEVDLLSKSYKVLISGELKTLMANSNSVQQKIDYI

GLNSELQKNIPYSFMDDKGKENGFINCSTKEGLFVSELSDVVLISKVYMD

NSKPLFGYCSNDLKDVKVITKDDVIILTGYYLKDDIKISLSFTIQDENTI

KLNGVYLDENGVAEILKFMNKKGSTNTSDSLMSFLESMNIKSIFINSLQS

NTKLILDTNFIISGTTSIGQFEFICDKDNNIQPYFIKFNTLETKYTLYVG

NRQNMIVEPNYDLDDSGDISSTVINFSQKYLYGIDSCVNKVIISPNIYTD

EINITPIYEANNTYPEVIVLDTNYISEKINININDLSIRYVWSNDGSDFI

LMSTDEENKVSQVKIRFTNVFKGNTISDKISFNFSDKQDVSINKVISTFT

PSYYVEGLLNYDLGLISLYNEKFYINNFGMMVSGLVYINDSLYYFKPPIK

NLITGFTTIGDDKYYFNPDNGGAASVGETIIDGKNYYFSQNGVLQTGVFS

TEDGFKYFAPADTLDENLEGEAIDFTGKLTIDENVYYFGDNYRAAIEWQT

LDDEVYYFSTDTGRAFKGLNQIGDDKFYFNSDGIMQKGFVNINDKTFYFD

DSGVMKSGYTEIDGKYFYFAENGEMQIGVFNTADGFKYFAHHDEDLGNEE

GEALSYSGILNFNNKIYYFDDSFTAVVGWKDLEDGSKYYFDEDTAEAYIG

ISIINDGKYYFNDSGIMQIGFVTINNEVFYFSDSGIVESGMQNIDDNYFY

IDENGLVQIGVFDTSDGYKYFAPANTVNDNIYGQAVEYSGLVRVGEDVYY

```
-continued
FGETYTIETGWIYDMENESDKYYFDPETKKAYKGINVIDDIKYYFDENGI

MRTGLITFEDNHYYFNEDGIMQYGYLNIEDKTFYFSEDGIMQIGVFNTPD

GFKYFAHQNTLDENFEGESINYTGWLDLDEKRYYFTDEYIAATGSVIIDG

EEYYFDPDTAQLVISE
```

In alternative embodiments of the invention, the TcdB protein comprises, consists, or consists essentially of mutations at any amino acid residue position described herein (i.e. W102, D288, E515, D286, S518, W520, and C698), wherein the specified amino acid residue is substituted with any other amino acid residue not present in a native sequence, e.g. the tryptophan at position 102 is substituted with any residue but tryptophan, the aspartic acid at position 288 is replaced with any amino acid residue but aspartic acid. For example, an alternative embodiment of the invention includes a variant of the TcdB sequence defined by SEQ ID NO:28 (5mTcdB: W102A, D288A, E515Q, W520A, C698A) which comprises or consists of mutations at positions W102, D288, E515, W520 and C698; wherein W102 is replaced with any amino acid except tryptophan, D288 is replaced with any amino acid but aspartic acid, E515 is replaced with any amino acid but glutamic acid, W520 is replaced with any amino acid but tryptophan and C698 is replaced with any amino acid but cysteine, as set forth in SEQ ID NO:71.

In preferred embodiments, the described amino acid residues (W102, D288, E515, D286, S518, W520, and C698) are substituted with amino acid residues that are similar in structure or in the same class as the mutations defined by W102A, D288A, E515Q, D286A, S518A, W520A, and C698A. For example, in preferred embodiments which comprise a W102 mutation, the tryptophan at position 102 is substituted with an amino acid in the same class or that has a similar structure to alanine.

In additional embodiments, the mutant TcdB protein is a derivative of the TcdB proteins described herein, e.g. a derivative of the TcdB proteins comprising an amino acid sequence as set forth in SEQ ID NO:19, SEQ ID NO:20, SEQ ID NO:21, SEQ ID NO:22, SEQ ID NO:23, SEQ ID NO:24, SEQ ID NO:27, SEQ ID NO:28, SEQ ID NO:58, SEQ ID NO:71. Such derivatives comprise amino acid sequences that are at least 85%, at least 90%, at least 95%, at least 97%, or at least 99% identical to the original reference sequence (e.g. SEQ ID NO:19, SEQ ID NO:20, SEQ ID NO:21, SEQ ID NO:22, SEQ ID NO:23, SEQ ID NO:24, SEQ ID NO:27, SEQ ID NO:28, SEQ ID NO:58 or SEQ ID NO:71). In a further embodiment, the invention includes TcdA protein derivatives that comprise modifications/alterations (e.g. substitutions) to no more than 12 amino acid residues, 11 amino acid residues, 10 amino acid residues, 9 amino acid residues, 8 amino acid residues, 7 amino acid residues, 6 amino acid residues, 5 amino acid residues, 4 amino acid residues, 3 amino acid residues, 2 amino acid residues, or 1 amino acid residue relative to SEQ ID NO:19, SEQ ID NO:20, SEQ ID NO:21, SEQ ID NO:22, SEQ ID NO:23, SEQ ID NO:24, SEQ ID NO:27, SEQ ID NO:28, SEQ ID NO:58 and SEQ ID NO:71.

Combinations of the any of the TcdA and TcdB mutant toxins described herein are useful in immunogenic compositions and vaccines for the prevention and/or treatment of C. difficile infection or CDAD, as described more fully, infra, and are encompasses by the invention.

The invention also relates to nucleotide sequences that encode the TcdA and TcdB mutants described herein. Said nucleotide sequences may be native sequences, with changes made to the native nucleotide sequence to encode a protein comprising a desired mutation, or codon-optimized nucleotide sequences that are designed to utilize codons that more closely match the codon usage of highly expressed genes of the desired expression system, e.g. E. coli, and Bacillus megaterium. In addition, other changes may be made to the nucleotide sequence without altering the encoded protein in order to increase expression or stability, e.g. GC content of the nucleotide sequence may be modified, additional nucleotides may be added for purposes of cloning, to add a purification tag (e.g. His tag or GST tag), to add a restriction site, etc. Changes may also be made to the nucleotide sequences to reduce the repetitiveness of the CROPs region to reduce recombination.

Thus, the invention relates to isolated nucleotide sequences encoding TcdA and TcdB mutant proteins. Exemplary nucleotide sequences of the invention encoding TcdA comprise, consist of, or consist essentially of a sequence of nucleotides as set forth in SEQ ID NO:1, SEQ ID NO:2, SEQ ID NO:3, SEQ ID NO:4, SEQ ID NO:5, SEQ ID NO:6, SEQ ID NO:29, SEQ ID NO:30, and SEQ ID NO:31. Exemplary nucleotide sequences encoding TcdB comprise, consist of, or consist essentially of a sequence of nucleotides as set forth in SEQ ID NO:13, SEQ ID NO:14, SEQ ID NO:15, SEQ ID NO:16, SEQ ID NO:17, SEQ ID NO:18, SEQ ID NO:32, SEQ ID NO:33, SEQ ID NO:34, and SEQ ID NO:57. Additional embodiments of the invention include nucleotide sequences that are derivatives of the nucleotide sequences disclosed herein, e.g. nucleotide sequences that hybridize under high stringency conditions to nucleic acid molecules that comprise or consist of a sequence of nucleotides as set forth in SEQ ID NO:1, SEQ ID NO:2, SEQ ID NO:3, SEQ ID NO:4, SEQ ID NO:5, SEQ ID NO:6, SEQ ID NO:29, SEQ ID NO:30, SEQ ID NO:31, SEQ ID NO:13, SEQ ID NO:14, SEQ ID NO:15, SEQ ID NO:16, SEQ ID NO:17, SEQ ID NO:18, SEQ ID NO:32, SEQ ID NO:33, SEQ ID NO:34, and SEQ ID NO:57.

The invention also relates to vectors comprising any of nucleic acids and derivatives of the invention, as well as host cells comprising any of the vectors of the invention.

CDTa and CDTb Proteins from Binary Toxin

Experiments described herein have demonstrated that immunization of hamsters with a vaccine that contains both the large clostridial toxins TcdA and TcdB, as well as binary toxin (CDTa and CDTb) induces significantly higher levels of protection against challenge with an epidemic NAP1/027/BI strain than a vaccine comprising TcdA and TcdB alone. To that end, the invention relates to vaccines and immunogenic compositions comprising mutant TcdA and/or TcdB proteins as described, supra, in combination with CDTa and/or CDTb. In preferred embodiments, the vaccines and immunogenic compositions of the invention comprise TcdA, TcdB, CDTa, and CDTb proteins.

Because binary toxin is an active toxin, it was desirable to create a genetically inactivated version of the toxin protein for use in a vaccine or immunogenic composition. The enzymatic component of the toxin, CDTa, was thus targeted for genetic inactivation. Six triple mutant variants of CDTa and two quadruple mutant variants of CDTa were designed to genetically inactivate CDTa: 3mCDTa1 (R302A, E385A, E387D); 3mCDTa2 (S345F, E385Q and E387Q); 4mCDTa3 (R302A, S345F, E385Q, E387Q); 3mCDTa4 (Y62A, Y69A, R255A); 3mCDTa5 (R359A, Y62A, Q307E); 3mCDTa6 (Y258A, F356A, S345F); 3mCDTa7 (N342A, Y253A, Y382A); and 4mCDTa8 (S345F, E385Q, E387Q, C2A).

For 3mCDTa1 (R302A, E385A, E387D), mutations were selected based on published mutagenesis/toxicity studies performed on CDTa, as well as Iota toxin (Ia), which has ~84.3% sequence identity with CDTa. Active site residues which are essential for catalytic activity in Iota toxin (Ia) are highly conserved in CDTa. (Perelle et al. Production of a complete binary toxin actin-specific ADP-ribosyltransferase by *Clostridium difficile* CD196. *Infection and Immunity* 65(4): 1402-1407 (1997); and Sundriyal et al. Structural basis for substrate recognition in enzymatic components of ADP-ribosyltransferase toxin CDTa from *Clostridium difficile*. *Journal of Biological Chemistry* 284 (42) 28713-28719 (2009); Perelle et al., Evidence that Arg-295, Glu-378 and Glu-380 are active site residues of the ADP-ribosyltransferase activity of iota toxin. *FEBS Letters* 395: 191-194. (1996); Nagahama et al., Characterization of the enzymatic component of *Clostridium perfringens* Iota toxin. *Journal of Bacteriology* 182(8) 2096-2103 (2000), and Tsuge et al., Crystal structure and site directed mutagenesis of the enzymatic components from *Clostridium perfringens* Iota toxin *J. Mol. Biol* 325: 471-483. (2003)). Therefore, our hypothesis was that equivalent residues in CDTa should also be essential for catalytic activity.

For 3mCDTa2, mutations (S345F, E385Q and E387Q) were selected based on the reports describing mutagenesis of CDTa (Nagahama et al.; Tsuge et al.; Perelle et al.; supra; Sundriyal et al., Structural basis for substrate recognition in enzymatic components of ADP-ribosyltransferase toxin CDTa from *Clostridium difficile*. *Journal of Biological Chemistry* 284 (42): 28713-28719 (2009); and Gulke et al. Characterization of the enzymatic component of the ADP-ribosyltransferase toxin CDTa from *Clostridium difficile*. *Infection and Immunity* 69(10): 6004-6011 (2001)). In addition, Sundriyal et al. described the crystal structure of CDTa and predicted that the mutation S345F would abrogate substrate binding by steric hindrance. A ~20 fold reduction in activity was observed with Ia S338A (Ia equivalent of S345), but no activity was observed with the S338F mutant (Nagahama et al.). Gulke et al. reported that similar to the observation with Ia, only a small reduction in activity resulted from S345A in CDTa.

4mCDTa3 (R302A, S345F, E385Q, E387Q) was designed to combine the mutations in 3mCDTa1 and 3mCDTa2. The mutations E385Q and E387Q were selected over E385A and E387D because these substituted residues are more similar to glutamate.

For 3mCDTa4 (Y67A, Y69A, R255A), mutations were made to residues that are involved in actin binding, based on a previous report that showed that mutation of actin recognition and ADP-ribosylation residues in iota toxin of *Clostridium perfringens* resulted in a reduction in cytotoxic and enzymatic activity (Tsuge et al., *Proc. Natl. Acad. Sci. USA* 105: 7399-7404. (2008)).

For 3mCDTa5 (R359A, Y67A, Q307E), the Y67A mutation was combined with mutations to two residues that interact with NAD (R359 and S307). R352 in iota toxin, which is the equivalent residue to R359 in CDTa, was shown to be essential for NADase activity (Tsuge et al., (2003), supra). Also, based on the crystalline structure of CDTa, it was predicted that NAD interacts with R359 and Q307 (Sundriyal et al., (2009)). For 3mCDTa6 (Y258A, F356A, S345F), additional mutations were selected based on the ability of equivalent iota toxin residues to effect ARTase and NADase activities (Tsuge et al., (2003)) or based on the CDTa crystal structure (Sundriyal et al., (2009)).

For 3mCDTa7 (N342A, Y253A, Y382A), mutations were made to residues that are thought to be involved in ligand binding, NADase activity, and/or ARTase activity (Sundriyal et al., (2009); Tsuge et al., (2003)) in Iota toxin. In addition, Y382 was selected because it is a conserved critical aromatic residue known to be import to actin-specific ADP-ribosylating toxins.

Figure 20A:
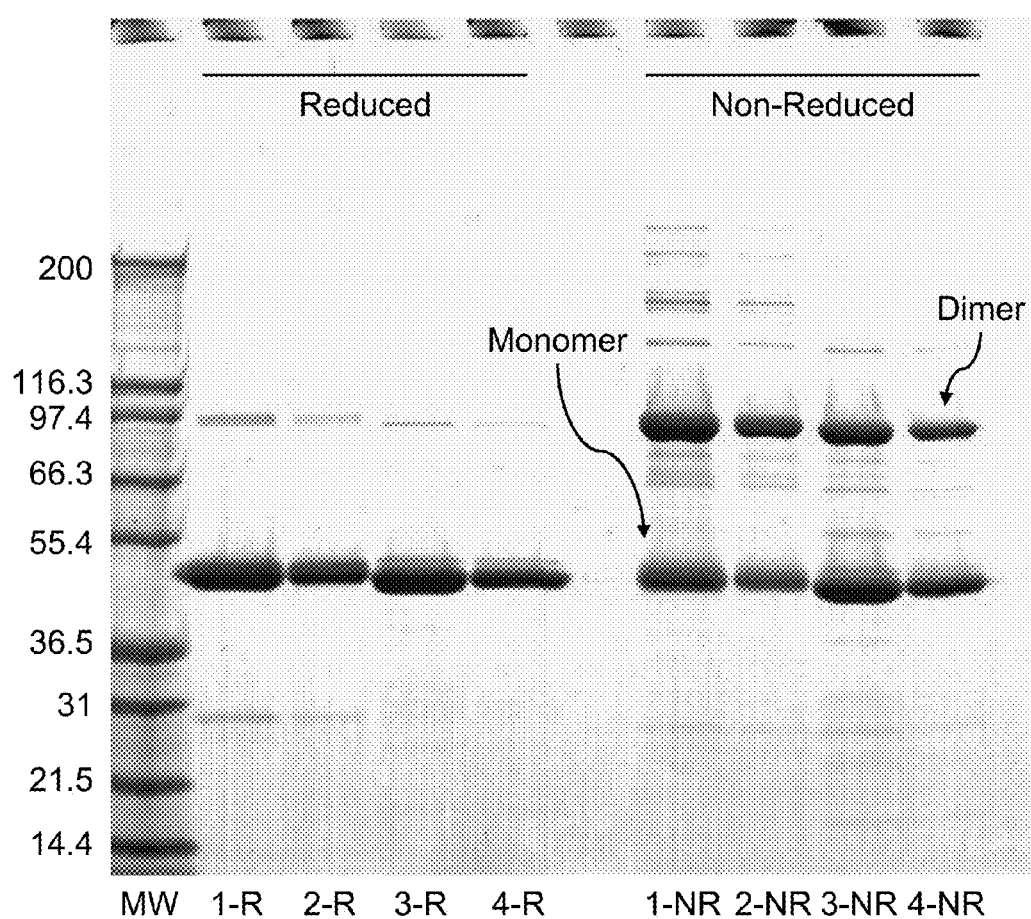
FIG. 20A provides the results of Western blot analysis of CDTa (lanes 1 and 2) and 3mCDTa_1 (lanes 3 and 4) under reducing and non-reducing conditions. Also shown is a size marker (left of lane 1) and the location of protein monomer and dimmer bands.

For 4mCDTa8, the mutation C2A was added to the mutations in 3mCDTa2 mutant based on our observation that wild type recombinant CDTa as well as the recombinant mutant CDTa had a tendency to dimerize. By examining the sequence of CDTa, we discovered a single cysteine residue, which we mutated to try to reduce or eliminate the dimerization of CDTa. Analytical analysis showed that this cysteine mutation dramatically decreased the oligomerization of mutant CDTa. See Example 13 and FIG. 20C.

Accordingly, the present invention is related to a recombinant binary toxin protein A (CDTa) comprising, consisting, or consisting essentially of at least two mutations at amino acid positions selected from the group consisting of: C2, Y67, Y69, Y253, R255, Y258, R302, Q307, N342, S345, F356, R359, Y382, E385, E385, E387, and E387. In specific embodiments of the invention the CDTa protein comprises or consists of at up to 2, up to 3, up to 4, up to 5, up to 6, up to 7, up to 8, up to 9, up to 10, up to 11, up to 12, up to 13, up to 14, up to 15, up to 16, or up to 17 mutations selected from the group consisting of: C2A, Y67A, Y69A, Y253A, R255A, Y258A, R302A, Q307E, N342A, S345F, F356A, R359A, Y382A, E385Q, E385A, E387Q, and E387D. In some embodiments, the CDTa mutations are selected from: C2A, R302A, S345F, E385Q, E385A, E387Q, and E387D. In some embodiments of the invention, the recombinant CDTa protein comprises or consists of a set of mutations selected from the group consisting of: (a) S345F, E385Q and E387Q; (b) R302A, E385A, E387D; (c) C2A, S345F, E385Q and E387Q; (d) R302A, S345F, E385Q and E387Q; (e) Y67A, Y69A, and R255A; (f) R359A, Y67A, and Q307E; (g) Y258A, F356A, S345F; and (h) N342A, Y253A and Y382A. In preferred embodiments of the invention, the CDTa protein lacks a signal peptide (i.e. the signal peptide of the native CDTa is deleted).

In additional embodiments of the invention, the CDTa mutant proteins described herein comprise one further mutation to the native sequence, e.g. a CDTa protein consisting of the mutations C2A, S345F, E385q and E387Q, plus one additional mutation. In additional embodiments of the invention, up to 2, 3, 4, 5, 6, 7, 8, 9, 10, 11, 12, 13, 14, 15, 16, 17, 18, 19 or 20 further mutations may be added to any of the CDTa proteins described in any embodiment herein.

In exemplary embodiments of the invention, the CDTa protein described above comprises, consists of, or consists essentially of a sequence of amino acids as set forth in SEQ ID NO:40, SEQ ID NO:42 or SEQ ID NO:67. In additional embodiments of the invention, the CDTa protein comprises, consists, or consists essentially of SEQ ID NO:40, SEQ ID NO:42 or SEQ ID NO:67 with an additional N-terminal methionine.

In alternative embodiments of the invention, the CDTa mutant protein comprises, consists, or consists essentially of mutations at any amino acid residue described herein (i.e. C2, Y67, Y69, Y253, R255, Y258, R302, Q307, N342, S345, F356, R359, Y382, E385, E385, E387, and E387), wherein the specified amino acid residue is substituted with any other amino acid residue not present in a native sequence, e.g. the cysteine at position 2 is substituted with any residue but cysteine and the Y at position 67 is substituted with any residue but tyrosine. For example, an alternative embodiment of the invention includes a variant of the CDTa sequence set forth in SEQ ID NO:67 (4mCdtA8: C2A, S345F, E385Q and E387Q) which comprises or consists of mutations at positions C2, S345, E385 and E387, wherein C2 is replaced with any amino acid except cysteine, 5345 is replaced with any amino acid except serine, E385 is replaced with any amino acid residue except glutamic acid and E387 is replaced with any amino acid except glutamic acid, as set forth in SEQ ID NO:72.

In preferred embodiments, the described amino acid residues (i.e. C2, Y67, Y69, Y253, R255, Y258, R302, Q307, N342, S345, F356, R359, Y382, E385, E385, E387, and E387) are substituted with amino acid residues that are similar in structure or in the same class as the mutations defined by C2A, Y67A, Y69A, Y253A, R255A, Y258A, R302A, Q307E, N342A, S345F, F356A, R359A, Y382A, E385Q, E385A, E387Q, and E387D.

In alternative embodiments, the invention provides mutant CDTa proteins comprising any of the mutations described above, or combinations thereof. Native CDTa protein sequences, which serve as the basis for introduction of mutations, can be from any *C. difficile* strain, e.g. NAP1/027/BI ("NAP") strain or VPI 10463 strain (i.e. the mutations described above may be incorporated into any CDTa reference sequence, for example, the CDTa sequence provided in SEQ ID NO:38, or a CDTa sequence from a different strain). Additional exemplary CDTa amino acid sequences that can form the backbone of the CDTa mutant sequences herein (i.e. mutations specified herein may be made to the reference "backbone" sequences at the specified positions) include the sequences set forth SEQ ID NO:73 (strain AM478 (toxinotype IV), GenBank Accession No.: AEC11575.1), SEQ ID NO:74 (strain CD98 (ribotype 078, NAP7, toxinotype V), GenBank Accession No.: AEC11569.1), SEQ ID NO:75 (strain AE16 (ribotype 027, NAP1, toxinotype III), GenBank Accession No.: AEC11560.1), SEQ ID NO:76 (strain CD196 (NAP1, toxinotypeIII, 027), GenBank Accession No.: AAB67304.2), and SEQ ID NO:77 (strain A765(toxinotype IX, NAP1), GenBank Accession No.: AEC11578.1). In additional embodiments of the invention, any of the recombinant CDTa proteins of the invention are substantially purified.

In additional embodiments, the mutant CDTa protein is a derivative of the CDTa proteins described herein, e.g. a derivative of the CDTa proteins comprising an amino acid sequence as set forth in SEQ ID NO:40, SEQ ID NO:42, SEQ ID NO:67, or SEQ ID NO:72: Such derivatives comprise amino acid sequences that are at least 85%, at least 90%, at least 95%, at least 97%, or at least 99% identical to the original reference sequence (e.g. SEQ ID NO:40, SEQ ID NO:42, SEQ ID NO:67, or SEQ ID NO:72). In a further embodiment, the invention includes CDTa protein derivatives that comprise modifications/alterations (e.g. substitutions) to no more than 12 amino acid residues, 11 amino acid residues, 10 amino acid residues, 9 amino acid residues, 8 amino acid residues, 7 amino acid residues, 6 amino acid residues, 5 amino acid residues, 4 amino acid residues, 3 amino acid residues, 2 amino acid residues, or 1 amino acid residue relative to SEQ ID NO:40, SEQ ID NO:42, SEQ ID NO:67, and SEQ ID NO:72. Additional embodiments of the invention include any derivative of the CDTa proteins described herein (e.g. SEQ ID NO:40, SEQ ID NO:42, SEQ ID NO:67, or SEQ ID NO:72) with an additional N-terminal methionine.

Also provided by the invention is an isolated and/or purified recombinant binary toxin protein B (CDTb), wherein the CDTb protein is lacking (i.e. contains a deletion of) the signal peptide (referred to herein as "pro-CDTb"). The isolated proCDTb protein of the invention can be derived from any *C. difficile* strain that, expresses binary toxin. Exemplary CDTb sequences that can be used in the compositions and vaccines described herein include the amino acid sequences set forth in SEQ ID NO:78 (strain CD98 (ribotype 078, NAP7, toxinotype V), GenBank Accession No.: AEC11570.1), SEQ ID NO:79 (strain K744 (ribotype 078, NAPS, toxinotype V), GenBank Accession No.: AEC11585.1), SEQ ID NO:80 (strain AM478 (toxinotype IV), GenBank Accession No.: AEC11576.1), SEQ ID NO:81 (strain AD667 (toxinotype III, NAP1), GenBank Accession No.: AEC11558.1), SEQ ID NO:82 (strain C421 (toxinotype IX), GenBank Accession No.: AEC11564.1), SEQ ID NO:83 (strain A765 (toxinotype IX, NAP1), GenBank Accession No.: AEC11579.1), SEQ ID NO:84 (strain CD196 (NAP1, toxinotype III, 027), GenBank Accession No.: AAB67305.1), and SEQ ID NO:85 (strain AE16 (ribotype 027, NAP1, toxinotype III), GenBank Accession No.: AEC11560.1).

In large multi-country clinical trials and/or epidemiological studies where strain typing was conducted on confirmed clinical cases of CDI in the U.S. and Europe, the predominant binary toxin expressing ribotypes were 027 and 078. In these studies, the prevalence of 027 and 078 ranged from 11% to 40% (Bauer, et al., *Lancet* 377(9759): 63-73 (2011); Gerding et al., *Nat Rev Gastroenterol Hepatol.* 8(2): 67-8 (2011)). In some embodiments of this aspect of the invention, the proCDTb amino acid sequence is derived from the NAP1 strain.

In specific embodiments, the proCDTb protein consists of, consists essentially of, or comprises a sequence of amino acids as shown below:

```
                                            (SEQ ID NO: 44)
EIVNEDILPNNGLMGYYFTDEHFKDLKLMAPIKDGNLKFEEKKVDKLLDK

DKSDVKSIRWTGRIIPSKDGEYTLSTDRDDVLMQVNTESTISNTLKVNMK

KGKEYKVRIELQDKNLGSIDNLSSPNLYWELDGMKKIIPEENLFLRDYSN

IEKDDPFIPNNNFFDPKLMSDWEDEDLDTDNDNIPDSYERNGYTIKDLIA

VKWEDSFAEQGYKKYVSNYLESNTAGDPYTDYEKASGSFDKAIKTEARDP

LVAAYPIVGVGMEKLIISTNEHASTDQGKTVSRATTNSKTESNTAGVSVN

VGYQNGFTANVTTNYSHTTDNSTAVQDSNGESWNTGLSINKGESAYINAN

VRYYNTGTAPMYKVTPTTNLVLDGDTLSTIKAQENQIGNNLSPGDTYPKK

GLSPLALNTMDQFSSRLIPINYDQLKKLDAGKQIKLETTQVSGNFGTKNS

SGQIVTEGNSWSDYISQIDSISASIILDTENESYERRVTAKNLQDPEDKT

PELTIGEAIEKAFGATKKDGLLYFNDIPIDESCVELIFDDNTANKIKDSL

KTLSDKKIYNVKLERGMNILIKTPTYFTNFDDYNNYPSTWSNVNTTNQDG

LQGSANKLNGETKIKIPMSELKPYKRYVFSGYSKDPLTSNSIIVKIKAKE

EKTDYLVPEQGYTKFSYEFETTEKDSSNIEITLIGSGTTYLDNLSITELN

STPEILDEPEVKIPTDQEIMDAHKIYFADLNFNPSTGNTYINGMYFAPTQ

TNKEALDYIQKYRVEATLQYSGFKDIGTKDKEMRNYLGDPNQPKTNYVNL

RSYFTGGENIMTYKKLRIYAITPDDRELLVLSVD
```

In additional embodiments of the invention, the isolated recombinant CDTb protein is further lacking (i.e. contains a deletion of the signal peptide and contains a further deletion of the N-terminal activation domain of CDTb (see Barth et al., *Microbiol. Mol. Biol. Rev.* 68(3): 373-402 (2004)). The CDTb protein of the invention can be derived from any *C. difficile* strain that comprises binary toxin. In some embodiments of this aspect of the invention, the CDTb protein sequence is derived from the NAP1 strain. In specific exemplary embodiments, the CDTb protein consists of, consists essentially of, or comprises a sequence of amino acids as set forth in SEQ ID NO:46. In additional embodiment, the CDTb protein is a derivative of the CDTb protein set forth in SEQ ID NO:46, e.g. a CDTb protein that comprises an amino acid sequence that is at least 85%, at least 90%, at least 95%, at least 97%, or at least 99% identical to SEQ ID NO:46. In a further embodiment, the invention includes CDTb protein derivatives that comprise modifications/alterations (e.g. substitutions) to no more than 12 amino acid residues, 11 amino acid residues, 10 amino acid residues, 9 amino acid residues, 8 amino acid residues, 7 amino acid residues, 6 amino acid residues, 5 amino acid residues, 4 amino acid residues, 3 amino acid residues, 2 amino acid residues, or 1 amino acid residue relative to SEQ ID NO:46.

The invention also relates to nucleotide sequences that encode the CDTa and CDTb mutants described herein. Said nucleotide sequences may be native sequences, with changes made to the native nucleotide sequence to encode a protein comprising a desired mutation, or codon-optimized nucleotide sequences that are designed to utilize codons that more closely match the codon usage of highly expressed genes of the desired expression system, e.g. E. coli, Bacillus megaterium, or insect cells. In addition, other changes may be made to the nucleotide sequence without altering the encoded protein in order to increase expression or stability, e.g. GC content of the nucleotide sequence may be modified, additional nucleotides may be added for purposes of cloning, to add a purification tag (e.g. His tag or GST tag), to add a restriction site, etc.

Thus, the invention relates to isolated nucleic acids encoding the CDTa mutant proteins of the invention. Exemplary nucleotide sequences encoding mutant CDTa proteins comprise, consist of, or consist essentially of a sequence of nucleotides as set forth in: SEQ ID NO:47, SEQ ID NO:48, SEQ ID NO:49, SEQ ID NO:50, SEQ ID NO:51, SEQ ID NO:52, SEQ ID NO:67, and SEQ ID NO:68. In some embodiments of the invention, the nucleic acids are substantially purified. Additional embodiments of the invention include nucleotide sequences that are derivatives of CDTa nucleotide sequences disclosed herein, e.g. nucleotide sequences that hybridize under high stringency conditions to nucleic acid molecules that comprise or consist of a sequence of nucleotides as set forth in SEQ ID NO:47, SEQ ID NO:48, SEQ ID NO:49, SEQ ID NO:50, SEQ ID NO:51, SEQ ID NO:52, SEQ ID NO:67, and SEQ ID NO:68.

The invention also relates to isolated nucleotide sequences encoding CDTb and proCDTb proteins as described, supra. Exemplary nucleotide sequences encoding CDTb comprise, consist of, or consist essentially of a sequence of nucleotides as set forth in: SEQ ID NO:53, SEQ ID NO:54, SEQ ID NO:55, and SEQ ID NO:56. In some embodiments of the invention, the nucleic acids are substantially purified. Additional embodiments of the invention include nucleotide sequences that are derivatives of CDTa nucleotide sequences disclosed herein, e.g. nucleotide sequences that hybridize under high stringency conditions to nucleic acid molecules that comprise or consist of a sequence of nucleotides as set forth in SEQ ID NO:53, SEQ ID NO:54, SEQ ID NO:55, and SEQ ID NO:56.

The invention also relates to vectors comprising any of nucleic acids of the invention, as well as host cells comprising any of the vectors of the invention.

Methods of Use

Embodiments of the invention also include one or more of the mutant TcdA, mutant TcdB, mutant CDTa and CDTb toxins or compositions comprising said toxins, described herein, or a vaccine comprising or consisting of said mutant toxins or compositions (i) for use in, (ii) for use as a medicament or composition for, or (iii) for use in the preparation of a medicament for: (a) therapy (e.g., of the human body); (b) medicine; (c) inhibition of C. difficile replication; (d) treatment or prophylaxis of infection by C. difficile; (e) prevention of recurrence of C. difficile infection; (f) reduction of the progression, onset or severity of pathological symptoms associated with C. difficile infection and/or reduction of the likelihood of a C. difficile infection or, (g) treatment, prophylaxis of, or delay in the onset, severity, or progression of C. difficile-associated disease(s), including, but not limited to: diarrhea, colitis and pseudomembranous colitis. In these uses, the mutant toxins, compositions thereof, and/or vaccines comprising or consisting of said mutant toxins or compositions can optionally be employed in combination with one or more anti-bacterial agents (e.g., anti-bacterial compounds; monoclonal antibodies, or combination vaccines, described infra).

Accordingly, the invention provides methods for the prophylactic and/or therapeutic treatment of C. difficile infection or C. difficile associated disease comprising administering one or more of the toxins, or immunogenic compositions or vaccines comprising said one or more toxin of the invention to a patient in need of treatment. In some preferred embodiments of this aspect the invention, the patient is administered a TcdA protein, a TcdB protein, a CDTa protein and a CDTb toxin protein, or a vaccine or immunogenic compositions comprising TcdA, TcdB, CDTa and CDTb.

A "patient" (alternatively referred to herein as a "subject") refers to a mammal capable of being infected with C. difficile. In preferred embodiments, the patient is a human. A patient can be treated prophylactically or therapeutically. Prophylactic treatment provides sufficient protective immunity to reduce the likelihood or severity of a C. difficile infection or the effects thereof, i.e., CDAD. Therapeutic treatment can be performed to reduce the severity or prevent recurrence of a C. difficile infection or of CDAD.

Prophylactic treatment can be performed using a pharmaceutical composition containing one or more of the mutant or isolated toxins described herein. Pharmaceutical compositions can be administered to the general population or to those persons at an increased risk of C. difficile infection.

The compositions of the invention may be administered to the patient as part of a therapeutic regime that includes additional agents. For example, the invention contemplates use of the immunogenic compositions in combination with antibiotics that are effective at treating or reducing the severity or progression of CDAD, e.g. metronidazole, vancomycin, and fidaxomycin. Also provided by the invention herein are therapeutic regimes in which the immunogenic compositions described herein are administered to a patient that is undergoing treatment with other pharmaceuticals or agents that are effective at treating or reducing the severity or progression of CDAD such as monoclonal antibodies targeting C. difficile, toxin A, or toxin B for example the monoclonal antibodies described by Ambrosino et al. in U.S. Pat. No. 7,625,559. In such cases, the vaccines and compositions described herein may be useful in preventing the recurrence of C. difficile infection or may reduce the severity or onset or progression of C. difficile infection or the effects thereof, e.g. CDAD; in a patient that has already been infected with C. difficile or is at high risk of being infected with C. difficile.

Those "in need of treatment" include those already with a C. difficile infection, as well as those prone to have an infection or any person in which a reduction in the likelihood of infection is desired. Persons with an increased risk of C. difficile infection include those undergoing antibiotic treatment, e.g. treatment with certain clindamycin, cephalosporins, and fluoroquinolones, as well as patients of advanced age (≥65 years), patients that are immunosuppressed, patients who are health care workers, and patients undergoing an extended duration of hospitalization.

As stated above, a feature of the invention is the use of one or more of the mutant or isolated toxins described herein, either alone or in combination with one or more additional antigens, in a composition, preferably an immunogenic composition or vaccine, for treating patients with or susceptible to a C. difficile infection. Suitably, said compositions comprise an effective amount of one or more of the mutant toxin proteins described herein (TcdA, TcdB, and CDTa) along with a CDTb protein and a pharmaceutically acceptable carrier. In preferred embodiments of the invention described above, the pharmaceutical compositions are used in human patients. In alternative embodiments, the pharmaceutical compositions are used in non-human patients.

The compositions of the invention may further comprise an adjuvant, e.g. an ISCOM-type adjuvant or an aluminum adjuvant. The inclusion of adjuvants may augment the immune response elicited by administration of the vaccine antigens (i.e. TcdA, TcdB, CDTa and/or CDTb) to a patient, in order to induce long lasting protective immunity. In addition to increasing the immune response, adjuvants may be used to decrease the amount of antigen necessary to provoke the desired immune response or decrease the number of injections needed in a clinical regimen to induce a durable immune response and to provide protection from disease and/or induce regression of disease caused by C. difficile infection.

Adjuvants that may be used in conjunction with the mutant and/or native toxin proteins of the present invention, include, but are not limited to, adjuvants containing CpG oligonucleotides, or other molecules acting on toll-like receptors such as TLR 4 and TLR9 (for reviews, see, Daubenberger, C. A., *Curr. Opin. Mol. Ther.* 9(1):45-52 (2007); Duthie et al., *Immunological Reviews* 239(1): 178-196 (2011); Hedayat et al., *Medicinal Research Reviews* 32(2): 294-325 (2012)), including lipopolysaccharide, monophosphoryl lipid A, and aminoalkyl glucosaminide 4-phosphates. Additional adjuvants useful in the compositions of the invention include immunostimulatory oligonucleotides (IMO's; see, e.g. U.S. Pat. No. 7,713,535 and U.S. Pat. No. 7,470,674); T-helper epitopes, lipid-A and derivatives or variants thereof, liposomes, calcium phosphate, cytokines, (e.g. granulocyte macrophage-colony stimulating factor (GM-CSF) IL-2, IFN-α, Flt-3L), CD40, CD28, CD70, IL-12, heat-shock protein (HSP) 90, CD134 (OX40), CD137, CoVaccine HT, non-ionic block copolymers, incomplete Freund's adjuvant, chemokines, cholera toxin; *E. coli* heat-labile enterotoxin; pertussis toxin; muramyl dipeptide, muramyl peptide analogues, MF59, SAF, immunostimulatory complexes, biodegradable microspheres, polyphosphazene; synthetic polynucleotides.

Additional adjuvants for use with the compositions described herein are adjuvants containing saponins (e.g. QS21), either alone or combined with cholesterol and phospholipid in the characteristic form of an ISCOM ("immune stimulating complex," for review, see Barr and Mitchell, *Immunology and Cell Biology* 74: 8-25 (1996); and Skene and Sutton, *Methods* 40: 53-59 (2006)). In specific embodiments of the compositions and methods provided herein, the mutant toxins and/or toxin proteins are combined with an ISCOM-type adjuvant or "ISCOM", which is an ISCOM matrix particle adjuvant, such as ISCOMATRIX® (also referred to herein as "IMX"), which is manufactured without antigen (ISCOM® and ISCOMATRIX® are the registered trademarks of CSL Limited, Parkville, Australia).

Additionally, aluminum-based compounds, such as aluminum hydroxide ($Al(OH)_3$), aluminum hydroxyphosphate ($AlPO_4$), amorphous aluminum hydroxyphosphate sulfate (AAHS) or so-called "alum" ($KAl(SO_4).12H_2O$) (see Klein et al., Analysis of aluminum hydroxyphosphate vaccine adjuvants by Al MAS NMR., *J. Pharm. Sci.* 89(3): 311-21 (2000)), may be combined with the compositions provided herein. In exemplary embodiments of the invention provided herein, the aluminum adjuvant is aluminum hydroxyphosphate or AAHS, alternatively referred to as "MAA".

The above compositions may be used as therapeutic or prophylactic vaccines. Accordingly, the invention extends to the production of vaccines containing as active ingredients one or more of the mutant or isolated toxins ("immunogenic agents"), or derivatives thereof, of the invention. Any suitable procedure is contemplated for producing such vaccines. Exemplary procedures include, for example, those described in New Generation Vaccines (1997, Levine et al., Marcel Dekker, Inc. New York, Basel, Hong Kong), which is incorporated herein by reference.

Mutant toxins of the invention, including derivative toxins, or compositions or vaccines comprising said mutant toxins or derivatives or native toxins such as CDTb (alone or in combination with one or more immunogens) can be formulated and administered to a patient using techniques well known in the art. Guidelines for pharmaceutical administration in general are provided in, for example, *Vaccines* Eds. Plotkin and Orenstein, W.B. Sanders Company, 1999; *Remington's Pharmaceutical Sciences* 20$^{th}$ Edition, Ed. Gennaro, Mack Publishing, 2000; and *Modern Pharmaceutics* 2$^{nd}$ Edition, Eds. Banker and Rhodes, Marcel Dekker, Inc., 1990.

Accordingly, the invention provides a method for inducing a protective immune response in a patient against a C. difficile infection comprising the step of administering to the patient an immunologically effective amount of any of the vaccines or pharmaceutical compositions described herein.

Also provided by the invention is a method for treating C. difficile infection, or for treating any pathological condition associated with C. difficile infection, the method comprising the step of administering to the patient an immunologically effective amount of any of the vaccines or pharmaceutical compositions described herein.

Vaccines and/or compositions can be administered by different routes such as subcutaneous, intramuscular, intravenous, mucosal, parenteral or transdermal. Subcutaneous and intramuscular administration can be performed using, for example, needles or jet-injectors. In preferred embodiments of the invention, the vaccines and compositions are administered by intramuscular injection.

The compositions described herein may be administered in a manner compatible with the dosage formulation, and in such amount as is immunologically-effective to treat and/or reduce the likelihood of C. difficile infection. The dose administered to a patient, in the context of the present invention, should be sufficient to affect a beneficial response in a patient over time such as a reduction in the level of C. difficile, or to reduce the likelihood of infection by C. difficile. The quantity of the immunogenic agent(s) to be administered may depend on the subject to be treated inclusive of the age, sex, weight and general health condition thereof. In this regard, precise amounts of the immunogenic agent(s) required to be administered will depend on the judgment of the practitioner. In determining the effective amount of the immunogenic agent to be administered in the treatment or prophylaxis against C. difficile infection, the physician may evaluate circulating plasma levels, progression of disease, and the production of anti-C. difficile antibodies. In any event, suitable dosages of the immunogenic agents of the invention may be readily determined by those of skill in the art. Such dosages may be in the order of nanograms to milligrams of the immunogenic agents of the invention.

Suitable dosing regimens are preferably determined taking into account factors well known in the art including age, weight, sex and medical condition of the patient; the route of administration; the desired effect; and the particular compound employed. The vaccine composition can be used in multi-dose formats.

The timing of doses depends upon factors well known in the art. After the initial administration one or more additional doses may be administered to maintain and/or boost antibody titers.

For combination vaccinations, each of the mutant toxins can be administered together in one composition or separately in different compositions. A mutant or isolated Tcd or CDT toxin of the invention as described herein can be administered concurrently with one or more desired additional immunogens. The term "concurrently" is not limited to the administration of the therapeutic agents at exactly the same time, but rather it is meant that the mutant or isolated Tcd and CDT toxins described herein and the other desired immunogen(s) are administered to a subject in a sequence and within a time interval such that the they can act together to provide an increased benefit than if they were administered otherwise. For example, each therapeutic agent may be administered at the same time or sequentially in any order at different points in time; however, if not administered at the same time, they should be administered sufficiently close in time so as to provide the desired therapeutic effect. Each therapeutic agent can be administered separately, in any appropriate form and by any suitable route.

In accordance with an aspect of the invention described above, there is provided an immunogenic composition comprising a recombinant C. difficile toxin A (TcdA) protein comprising at least 3 mutations selected from the group consisting of: W101A, D287A, E514Q, D285A, S517A, W519A, and C700A and a pharmaceutically acceptable carrier. In embodiments of this aspect of the invention, the TcdA protein comprises a set of mutations selected from the group consisting of: (a) W101A, D287A, E515Q; (b) W101, D287A, E514Q, and W519A; (c) W101A, D287A, E514Q and D285A and (d) W101A, D287A, E514Q and S517A. In further embodiments, the TcdA protein further comprises a C700A mutation, for example, the following set of mutations (e) W101A, D287A, E514Q, W519A and C700A. In additional embodiments, the TcdA protein comprises a sequence of amino acids that is obtained from C. difficile NAP strain or VPI 10463 strain. In further embodiments, the TcdA protein comprises a sequence of amino acids selected from the group consisting of: SEQ ID NO:7, SEQ ID NO:8, SEQ ID NO:9, SEQ ID NO:10, SEQ ID NO:11, SEQ ID NO:12, SEQ ID NO:25, SEQ ID NO:26, and SEQ ID NO:35.

The invention also relates to an immunogenic composition comprising a recombinant C. difficile toxin B (TcdB) protein comprising at least 3 mutations selected from the group consisting of: W102A, D288A, E515Q, D286A, S518A, W520A, and C698A; and a pharmaceutically acceptable carrier. In additional embodiments of this aspect of the invention, the TcdB protein comprises a set of mutations selected from the group consisting of: (a) W102, D288A, and E515Q; (b) W102, D288A, E515Q, and W520A; (c) W102A, D288A, E515Q and D286A; and (d) W102A, D288A, E515Q and S518A. In further embodiments, the TcdB protein further comprises a C698A mutation, for example, the set of mutations (e) W102A, D288A, E515Q, W520A and C698A. In still further embodiments, the TcdB protein comprises a sequence of amino acids that is obtained from C. difficile NAP strain or VPI 10463 strain. In specific embodiments of this aspect of the invention, the TcdB protein comprises a sequence of amino acids selected from the group consisting of: SEQ ID NO:19, SEQ ID NO:20, SEQ ID NO:21, SEQ ID NO:22, SEQ ID NO:23, SEQ ID NO:24, SEQ ID NO:27, SEQ ID NO:28, and SEQ ID NO:58. In additional embodiments of the invention, any of the mutant TcdB toxin proteins described, supra, can be combined with any other mutant toxin proteins disclosed throughout the specification, for example, the mutant TcdA proteins, described, supra.

Thus, one embodiment of the invention is an immunogenic composition comprising a mutant TcdA protein, a mutant TcdB protein, and a pharmaceutically acceptable carrier. In embodiments of this aspect invention, the TcdA protein comprises at least 3 mutations selected from the group consisting of: W101A, D287A, E514Q, D285A, S517A, W519A, and C700A; and the TcdB protein comprises at least 3 mutations selected from the group consisting of: W102A, D288A, E515Q, D286A, S518A, W520A, and C698A. In further embodiments, the immunogenic compositions of the invention comprise a mutant TcdA, as described herein, a mutant TcdB protein, as described herein, a mutant CDTa protein, wherein the mutant TcdA protein comprises at least two mutations selected from C2A, Y67A, Y69A, Y253A, R255A, Y258A, R302A, Q307E, N342A, S345F, F356A, R359A, Y382A, E385Q, E385A, E387Q, and E387D, and a CDTb protein. In embodiments of this aspect of the invention, the CDTa and the CDTb proteins lack a signal peptide. In additional embodiments, any of the immunogenic compositions described herein may further comprise an adjuvant. In still further embodiments, the adjuvant is an ISCOM-type adjuvant such as ISCOMATRIX (CSL, Ltd.) and/or an aluminum adjuvant such as MAA.

The invention additionally relates to an immunogenic composition comprising a recombinant binary toxin protein A (CDTa) comprising at least two mutations selected from C2A, Y67A, Y69A, Y253A, R255A, Y258A, R302A, Q307E, N342A, S345F, F356A, R359A, Y382A, E385Q, E385A, E387Q, and E387D and binary toxin protein B (CDTb) from C. difficile and a pharmaceutically acceptable carrier. In additional embodiments, the immunogenic composition comprises a CDTa protein consisting of up to 2, up to 3, up to 4, up to five, up to 6, up to 7, up to 8, up to 9, up to 10, up to 11, up to 12, up to 13, up to 14, up to 15, up to 16 or up to 17 mutations selected from the group consisting of: C2A, Y67A, Y69A, Y253A, R255A, Y258A, R302A, Q307E, N342A, S345F, F356A, R359A, Y382A, E385Q, E385A, E387Q, and E387D. In some embodiments of the invention, the CDTa protein comprises or consists of a set of mutations selected from the group consisting of: (a) S345F, E385Q and E387Q; (b) R302A, E385A, E387D; (c) C2A, S345F, E385Q and E387Q; (d) R302A, S345F, E385Q and E387Q; (e) Y67A, Y69A, and R255A; (f) R359A, Y67A, and Q307E; (g) Y258A, F356A, S345F; and (h) N342A, Y253A and Y382A. In further embodiments, the CDTa protein comprises or consists of a sequence of amino acids as set forth in SEQ ID NO:40 or SEQ ID NO:42.

In still further embodiments, the CDTa protein comprises or consists of the sequence shown below:

(SEQ ID NO: 67)
VANTTYKAPIERPEDFLKDKEKAKEWERKEAERIEQKLERSEKEALESYK

KDSVEISKYSQTRNYFYDYQIEANSREKEYKELRNAISKNKIDKPMYVYY

```
FESPEKFAFNKVIRTENQNEISLEKFNEFKETIQNKLFKQDGFKDISLYE

PGKGDEKPTPLLMHLKLPRNTGMLPYTNTNNVSTLIEQGYSIKIDKIVRI

VIDGKHYIKAEASVVSSLDFKDDVSKGDSWGKANYNDWSNKLTPNELADV

NDYMRGGYTAINNYLISNGPVNNPNPELDSKITNIENALKREPIPTNLTV

YRRSGPQEFGLTLTSPEYDFNKLENIDAFKSKWEGQALSYPNFIFTSIGS

VNMSAFAKRKIVLRITIPKGSPGAYLSAIPGYAGQYQVLLNHGSKFKINK

IDSYKDGTITKLIVDATLIP.
```

In alternative embodiments, the CDTa protein comprises or consists of SEQ ID NO:67 with an additional N-terminal methionine. In additional embodiments, the CDTa protein comprises or consists of SEQ ID NO:40 or SEQ ID NO:42 with an additional N-terminal methionine.

In additional embodiments, the immunogenic composition comprises any of the CDTa proteins described herein and a CDTb protein that is lacking a signal peptide (i.e. the signal peptide is deleted). In still further embodiments, the composition comprises any CDTa protein as described herein and a CDTb protein which lacks both a signal peptide and an activation domain (i.e. the signal peptide and the activation domain is deleted).

Also provided by the invention is an immunogenic composition comprising any of the recombinant mutant TcdA proteins as described herein, any of the recombinant mutant TcdB proteins described herein, any of the recombinant mutant CDTa proteins described herein and a CDTb protein that lacks a signal peptide, and a pharmaceutically acceptable carrier. In additional embodiments, the composition described further comprises an adjuvant. In further embodiments, the adjuvant is an aluminum adjuvant and/or an ISCOM-type adjuvant.

In alternative embodiments of the compositions of the invention, the mutant TcdA, TcdB, and/or CDTa proteins described herein may be combined with a native TcdA, TcdB and/or CDTa protein (e.g., a toxoid protein that does not comprise any mutations relative to the native TcdA or TcdB protein of the same strain, but has been detoxified, or has had its toxicity substantially reduced through chemical means, such as through the use of formaldehyde). Such compositions may also include CDTb. In additional alternative embodiments, the mutant TcdA, TcdB, and/or mutant CDTa proteins described herein may also be treated with formaldehyde to further reduce or eliminate residual toxicity.

The invention also relates to an immunogenic composition comprising (a) a TcdA protein which comprises or consists of the mutations W101, D287A, E514Q, W519A; or a TcdA protein which comprises or consists of the mutations W101, D287A, E514Q, and W519A, and C700A; (b) a TcdB protein which comprises or consists of the mutations W102A, D288A, E515Q, W520A and C698A; or a TcdB protein which comprises or consists of the mutations W102A, D288A, E515Q, and W520A; (c) a CDTa protein which lacks a signal peptide and comprises or consists of the mutations S345F, E385Q, E387Q, and C2A; and (d) a CDTb protein which lacks a signal peptide. In alternative embodiments, the CDTb protein lacks a signal peptide and an activation domain. In further embodiments the composition further comprises an aluminum adjuvant or an ISCOM-type adjuvant such as ISCOMATRIX®. In still further embodiment, the compositions described herein comprise an aluminum adjuvant and an ISCOM-type adjuvant.

Expression of Recombinant Toxins

The toxin proteins described herein, or derivatives thereof for use in the methods of the invention, are produced recombinantly and, if needed, chemically modified, e.g. with formaldehyde. In preferred embodiments of the invention, recombinant toxins are not further inactivated through chemical means such as formaldehyde inactivation following recombinant expression in the chosen host cell expression system. Recombinant expression of a polypeptide requires construction of an expression vector containing a polynucleotide that encodes the polypeptide of interest (i.e., a TcdA, TcdB, CDTa or CDTb polypeptide, as described herein, or derivative thereof). Once a polynucleotide encoding the polypeptide of interest has been obtained, the vector for the production of the polypeptide of interest may be produced by recombinant DNA technology using techniques well known in the art. Thus, methods for preparing a polypeptide of interest by expressing a polynucleotide encoding said polypeptide are described herein.

Methods which are well known to those skilled in the art can be used to construct expression vectors containing the coding sequences of the polypeptide of interest and appropriate transcriptional and translational control signals. These methods include, for example, in vitro recombinant DNA techniques, synthetic techniques, and in vivo genetic recombination. The invention, thus, provides replicable vectors comprising a nucleotide sequence encoding a polypeptide of interest operably linked to a promoter.

The expression vector is transferred to a host cell by conventional techniques and the transfected cells are then cultured by conventional techniques under conditions which allow expression of the nucleotide sequences to produce the polypeptide of interest. Thus, the invention includes host cells containing a polynucleotide encoding a polypeptide of interest operably linked to a heterologous promoter. As defined herein, the term "host cell" is not intended to include a host cell in the body of a transgenic human being, transgenic human fetus, or transgenic human embryos.

Following expression of the recombinant nucleotide sequences that encode TcdA, TcdB, CDTa, CDTb, or mutant or derivative forms thereof in a host cell, toxin protein(s) may be recovered to provide substantially purified protein for use in the immunogenic vaccines and compositions described herein. Several protein purification procedures are available and suitable for use. Recombinant toxin protein may be purified from cell lysates and extracts by various combinations of, or individual application of salt fractionation, ion exchange chromatography, size exclusion chromatography, hydroxyapatite adsorption chromatography and hydrophobic interaction chromatography. In addition, recombinant protein can be separated from other cellular proteins by use of an immunoaffinity column made with monoclonal or polyclonal antibodies specific for the toxin proteins or derivatives or fragments thereof.

A variety of host-expression vector systems may be utilized to express the polypeptides of interest. Such host-expression systems represent vehicles by which the coding sequences of interest may be produced and subsequently purified, but also represent cells which may, when transformed or transfected with the appropriate nucleotide coding sequences, express the polypeptide of interest in situ. These include but are not limited to microorganisms such as *E. coli* or *Bacillus megaterium* transformed with DNA expression vectors containing coding sequences of interest (i.e. sequences encoding the mutant TcdA, mutant TcdB, CDTa, and CDTb proteins described herein); and insect cell systems infected with recombinant virus expression vectors (e.g., baculovirus) containing coding sequences of interest.

In order to obtain a sufficient amount of *C. difficile* toxins for commercial vaccine production, it would be beneficial to develop a method for expressing a recombinant TcdA and/or TcdB in a recombinant expression system that overcomes the low production yields and safety issues associated with isolating native toxins from *C. difficile* bacteria grown in culture. Because *C. difficile* is an anaerobic, spore-forming organism, production of Tcd toxins in culture results in very low quantities and is thus costly. Additionally, chemical inactivation of the toxins can be difficult and may lead to contamination, which leads to a safety issue for commercial vaccine production. To that end, preferred embodiments of the invention relate to methods for recombinantly expressing *C. difficile* TcdA, TcdB, CDTa, and CDTb proteins, e.g. a TcdA, TcdB, CDTa, and CDTb protein as described, supra, or a derivative thereof, in a baculovirus/insect cell expression system, as described below, which results in high quantities of both toxin A and toxin B.

As described herein, in order to overcome difficulties encountered in expression of recombinant TcdA and TcdB, several expression platforms were evaluated. Results showed that *E. coli* was not an optimal expression platform because 3mTcdA could not be expressed using this system. Additionally, although 3mTcdB was successfully expressed in *E. coli*, the expression product that resulted from expression in the *E. coli* system contained a higher amount of degraded material than recombinant toxins produced in other expression systems. The ability of 4mTcdA/B to be expressed in *E. coli* was also evaluated. Consistent with results obtained with 3mTcdA, 4mTcdA failed to be expressed in this host system but 4mTcdB was made at high levels (~1.6 g/L). The *B. megaterium* expression system was also evaluated and successfully made low to moderate amounts of 5mTcdA (~75 mg/L) and 5mTcdB (~200-700 mg/L).

Due to the sub-optimal results described above, which were not consistent for both TcdA and TcdB mutants and thus not a good candidate for a commercial expression platform, the insect cell/Baculovirus production platform was evaluated. Alternative expression systems were evaluated prior to the insect cell/Baculovirus system, because it was thought that unless the mutant toxins were completely devoid of residual activity, expression of these toxins would be lethal to the insect cell host due to the action of the toxins on Rho proteins. All eukaryotic cells, including insect cells, produce Rho proteins, which have a role in cell proliferation and gene expression and control the organization of the actin cytoskeleton. Because the mode of action of both TcdA and TcdB is to inactivate Rho GTPases, leading to cell rounding and cell death, any residual toxicity could kill the cells. Thus, to increase the chances of successful toxin expression and to increase yields of intact antigen using this system, we tested 5mTcdA and 5mTcdB. Results described herein showed that both 5mTcdA/B toxins were successfully expressed in this system. Additionally, stability testing performed with detoxified TcdA produced in this system showed no detectable degradation when stored for 6 weeks at 27° C. in culture medium.

Accordingly, the present invention relates to methods for the production of *C. difficile* toxin A and B by recombinant expression of a nucleotide sequence encoding a Tcd protein comprising at least 4 or at least 5 mutations in a baculovirus expression system in cell culture. In preferred embodiments of the invention, the host cell is an insect cell. In preferred embodiments of the method described above, TcdA comprising the mutations W101A, D287A, E514Q, W519A and C700A is expressed in the baculovirus expression system. In additional preferred embodiments, TcdB proteins comprising the mutations W102A, D288A, E515Q, W520A, and C698A is expressed in the baculovirus expression system.

Thus, the invention provides a method of producing *C. difficile* TcdA protein, comprising transforming an host cell with a vector comprising a nucleotide sequence that encodes a TcdA mutant protein as described herein, wherein the protein comprises at least 3, at least 4 or at least 5 mutations, under conditions that permit expression of the nucleotide sequence to produce the TcdA protein. In certain embodiments of the invention, the host cell is an insect cell and the vector is a baculovirus vector.

The invention further provides a method of producing *C. difficile* TcdB protein, comprising transforming a host cell with a vector comprising a nucleotide sequence that encodes a TcdB mutant protein as described herein, wherein the protein comprises at least 3, at least 4, or at least 5 mutations, under conditions that permit expression of the nucleotide sequence to produce the TcdB protein. In certain embodiments of the invention, the host cell is an insect cell and the vector is a baculovirus vector.

The invention further relates to methods for the production of binary toxin A and binary B from *C. difficile* by recombinant expression of a nucleotide sequence encoding a CDTa protein or a CDTb protein, as described throughout the specification.

Thus, the invention provides a method of producing CDTa protein, comprising transforming a host cell with a vector comprising a nucleotide sequence that encodes a CDTa mutant protein as described herein, wherein the protein comprises at least 2, at least 3, or at least 4 mutations, under conditions that permit expression of the nucleotide sequence to produce the CDTa protein. In certain embodiments of the invention, the host cell is an insect cell and the vector is a baculovirus vector.

The invention further provides a method of producing CDTb protein, comprising transforming a host cell with a vector comprising a nucleotide sequence that encodes a CDTb protein as described herein, under conditions that permit expression of the nucleotide sequence to produce the CDTb protein. In certain embodiments of the invention, the host cell is an insect cell and the vector is a baculovirus vector.

All publications mentioned herein are incorporated by reference for the purpose of describing and disclosing methodologies and materials that might be used in connection with the present invention. Nothing herein is to be construed as an admission that the invention is not entitled to antedate such disclosure by virtue of prior invention.

Having described preferred embodiments of the invention with reference to the accompanying drawings, it is to be understood that the invention is not limited to those precise embodiments, and that various changes and modifications may be effected therein by one skilled in the art without departing from the scope or spirit of the invention as defined in the appended claims.

Example 1

Expression of *C. difficile* TcdA and TcdB Mutants in *E. coli*

Mutagenesis was performed on *C. difficile* native toxin A and toxin B-encoding nucleotide sequences derived from VPI10463 strain using a Quick Change® XL Site Directed Mutagenesis kit (Stratagene Corp., La Jolla, Calif.). Several mutant toxins with different combinations of mutations were made as shown in FIG. 3. Mutants were expressed and purified from *E. coli*. In addition, nucleotide sequences codon-optimized for the *E. coli* expression system were obtained from GenScript (GenScript USA, Inc., Piscataway, N.J.). Of the mutants shown in FIG. 3, only the *E. coli* codon-optimized triple mutant TcdB (W102A, D288A, E515Q) was expressed in a full length form. Additional constructs were tested which consisted of only of the enzyme domain expressed in *E. coli*.

Figure 4:
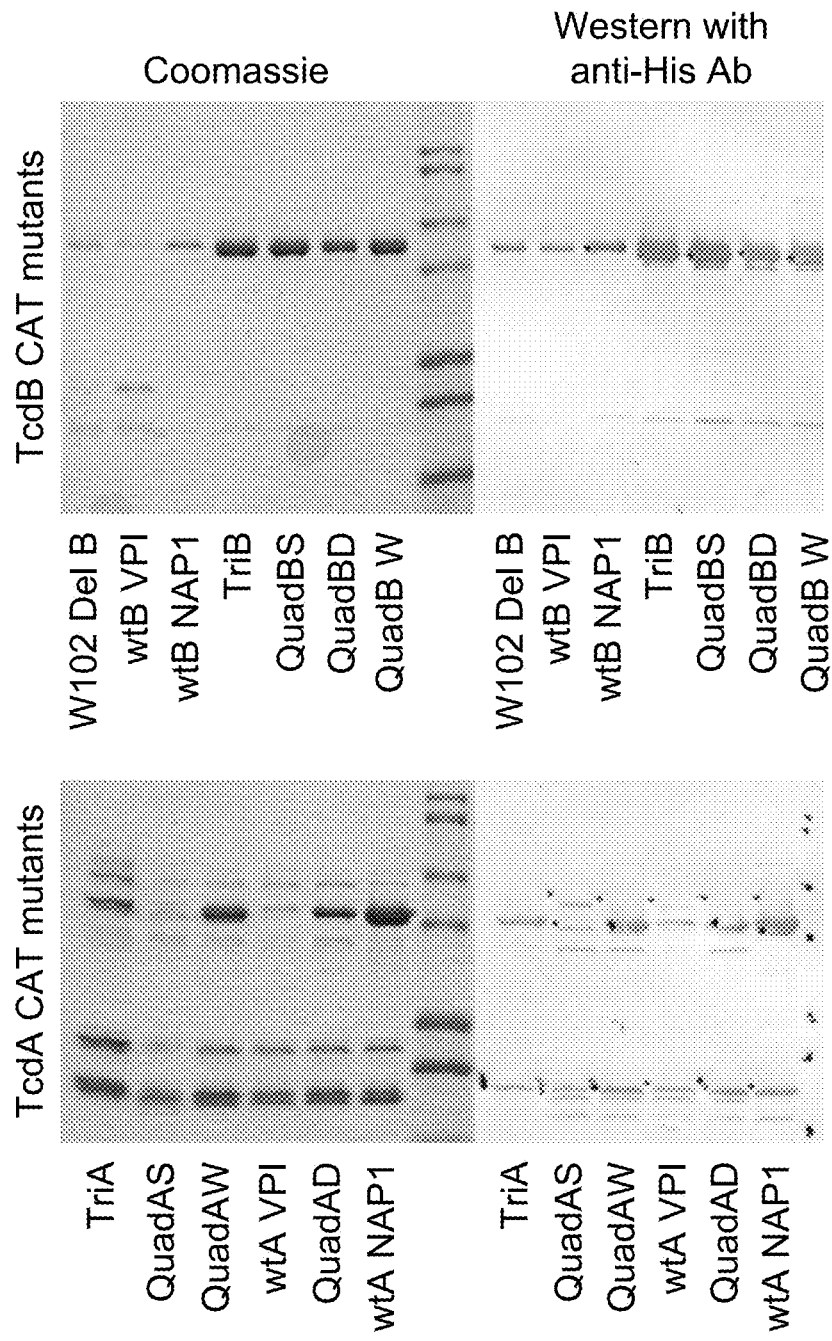
FIG. 4 shows expression of Tcd mutant enzyme domains (catalytic domains, TcdB mutants, top; TcdA mutants, lower) in *E. coli*. Analysis of purified hexa-histidine tagged enzyme domains by SDS-PAGE followed by Coomassie Blue staining is shown (left panels). The identity and integrity of the proteins was confirmed by Western Blot analysis (right panels) using an anti-His MAb.

Expression of the constructs in *E. coli* was evaluated by SDS-PAGE. As shown in FIG. 4, analysis of expression of Tcd mutant enzyme domains (catalytic domains) in *E. coli* generally displayed one major recombinant band of ~60 kDa with a variable profile of degradation products. The identity and integrity of the proteins was confirmed by Western Blot analysis using an anti-His MAb (FIG. 4).

Example 2

Determination of TcdA and TcdB Enzyme Activity with RhoA Glucosylation Assay

The toxicity of the recombinant TcdA and TcdB enzyme domains were compared in vitro using a RhoA glucosylation activity assay. Briefly, the proteins were mixed at two different concentration levels (1 and 10 µg/mL) with a reaction buffer containing the substrate (recombinant RhoA-GTPase), cofactor (MnII) and a radiolabeled cosubstrate (UDP-14C-Glucose). The reaction was incubated for 90 minutes at 37° C. and the proteins, along with any incorporated 14C were precipitated with ice-cold 10% trichloroacetic acid. The precipitated material was recovered by filtration and the filters were quantified in a liquid scintillation counter.

Results of the assay for TcdB are shown in FIG. 5. The triple mutant W102A, D288A, E515Q catalytic domain appeared to retain about 10% of the glucosylation activity of the native catalytic domain, which was comparable activity to the W102 deletion mutant. QuadS (W102A, D288A, E515Q, S518A), Quad W (W102A, D288A, E515Q, W520A) and Delta W102 yielded no detectable enzymatic activity. For the full length toxins, 3mTcdB retained ~0.5% of the activity of the full length toxin. Differences in toxicity between the 3mTcdB catalytic domain fragment and full length 3mTcdB may be due to differences in folding or purity. Similar results were observed for TcdA.

Figure 6:
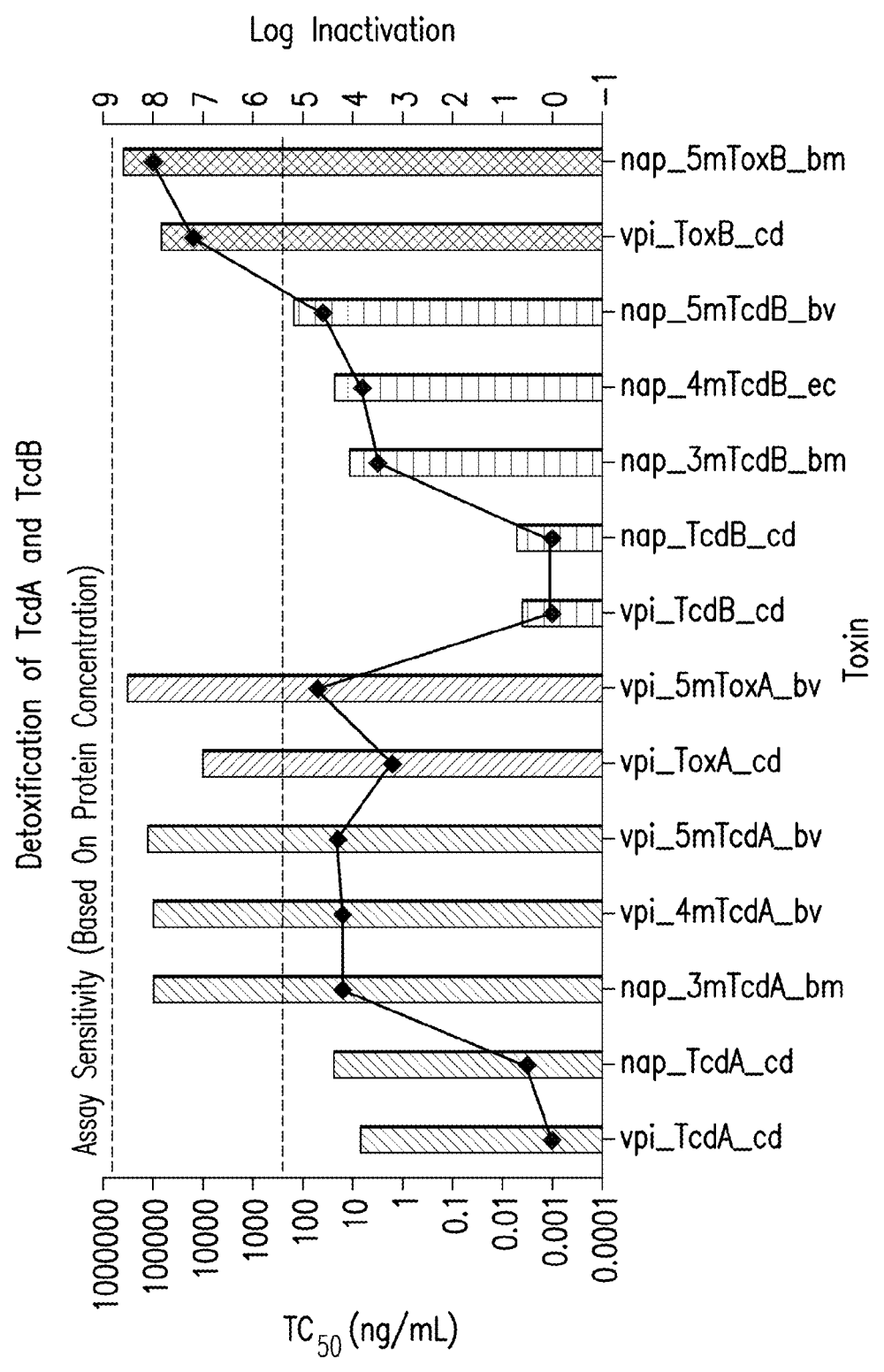

Based on this data, a fourth mutation was introduced into the full length mutant toxins (W102A, D288A, E515Q, W520A). 4mTcdA and 4mTcdB constructs were expressed in insect cells (Baculovirus expression system) and *B. megaterium*. Despite the addition of this fourth mutation, residual toxicity was still observed following immunization of animals. Therefore, a fifth mutation was introduced: C698A. C698A is the key residue of the cysteine protease which is responsible for cleaving the catalytic domain from the translocation domain allowing its release into the cytoplasm. The introduction of this mutation led to an additional ten-fold decrease in toxicity of TcdB (FIG. 6).

Example 3

Expression of TcdA and TcdB in the Baculovirus Expression System

In order to overcome difficulties encountered in expression of recombinant TcdA and TcdB, several expression platforms were evaluated. Initially *E. coli* was tested; however we were unable to express 3mTcdA using this system and although 3mTcdB was successfully expressed, it was partially degraded. We also evaluated expression of 4mTcdA/B in *E. coli*, and again, 4mTcdA was not successfully made in this host system but 4mTcdB was made at high levels (~1.6 g/L). The *B. megaterium* expression system was also evaluated and successfully made low to moderate amounts of 5mTcdA (~75 mg/L) and 5mTcdB (~200-700 mg/L)

*Bacillus megaterium* was evaluated as an expression host based on previous examples of expression of full length TcdA and TcdB in this organism (Burger et al., *Biochem Biophys Res. Commun.* 307(3): 584-8 (2003); Yang et al., *BMC Microbiol.* 8:192 (2008)). This expression host yielded increased production of 3mTcdA and 3mTcdB (source sequence NAP1 strain), however immunization of hamsters and monkeys with these molecules revealed that these preparations contained unacceptably high levels of residual toxicity in the absence of formaldehyde inactivation.

To increase yields of intact antigen, we next evaluated the use of the insect cell/Baculovirus production platform for 5mTcdA and 5mTcdB. For baculovirus mediated expression in insect cells, TcdA sequence from *C. difficile* strain VPI10463 modified with either W101A, D287A, E514Q, W519A mutations (referred henceforth by TcdA_VPI_4M) or W101A, D287A, E514Q, W519A and C700A mutations (referred henceforth by TcdA_VPI_5M) was used. In addition, TcdB sequence from *C. difficile* strain NAP1/027/BI modified with the following mutations: W102A, D288A, E515Q, W520A and C698A (referred henceforth by TcdB_NAP_5M) was used.

The recombinant baculovirus was created using the Bac-to-Bac expression system (Invitrogen, Carlsbad, Calif.), as described in more detail below for TcdA variants. The DNA sequences were made by gene synthesis and cloned into NotI/SphI restriction sites in the pFastBac™ transfer vector. For cloning of TcdA mutants, A NotI restriction site was introduced in plasmid VPIA_BM_pUC57 at the BsrGI restriction site upstream of the TcdA coding sequence. The constructs contained *Bacillus megaterium* optimized *Clostridium difficile* toxin A sequences (TcdA_BM) cloned in pUC57. Oligonucleotides used for insertion of NotI were as follows: BsrGI-NotI F-5' G T A C A G C G G C C G C T 3' (SEQ ID NO:36) and BsrGI-NotI R-5' T C G C C G G C G A C A T G 3' (SEQ ID NO:37). The resulting VPIA_BM_pUC57_NotI was digested with NotI and SphI to obtain the TcdA_BM gene which could then be cloned into the NotI/SphI digested pFastbac1 vector. This resulted in transfer plasmid pFbTcdA_BM The pFastBac™ was then transformed into competent DH10Bac™ *E. coli* carrying the parent bacmid, where it recombined to yield the recombinant Bacmid. For TcdA mutants, transformation was done in two types of bacterial competent cells. The first was standard DH10Bac™ *E. coli* cells provided with the Bac-to-Bac Baculovirus expression system (Invitrogen, Life Technologies) and the second was BacdCCDH10 cells (Dr. M van Oers (University of Wageningen, N L, S. Kaba et al. *Journal of Virological Methods* 122 (2004) 113-118). The baculovirus genome cloned as a bacmid in BacdCC cells, contains a deletion of v-cathepsin and chitinase genes that were replaced by a chloramphenicol resistance gene. Transformations were carried out in accordance with the manual provided with the Bac-to-Bac expression system. For the selection of recombinants with BacdCC DH10 cells, 25 µg/ml chloramphenicol was added to the Luria Bertani agar plates. From colonies that remained white after restreaking, cultures were grown and bacmid DNA was isolated and used for transfections.

The recombinant Bacmid was then extracted and used to transfect Sf9 and Sf21 insect cells, where the Baculovirus was generated and passaged 1-2 times to make sufficient recombinant Baculovirus for experiments. Transfections were carried out in accordance with the Invitrogen Bac-to-Bac manual. The Baculovirus was titrated using a $TCID_{50}$ assay or a commercial Baculovirus Titering Kit (Expression Systems, LLC, Woodland, Calif.). Except for slight differences in the purification process conditions, the two TcdA variants and the TcdB variant were treated similarly.

Example 4

Method for Growth and Induction of Insect Cells

SF9 (ATCC), SF21 cells (Kemp Biotechnologies, Inc.), SF21CB (Intervet) and ExpresSF+ (Protein Sciences, Meriden, Conn.) were cultivated in shake flasks (culture volume=⅕-½ of flask volume) using serum-free Sf900-II or Sf900-III media (Invitrogen, Carlsbad, Calif.) at 27° C. and agitated at 50-150 RPM using a shaker with a 1-2" throw. Cells were split and maintained between $0.5 \times 10^6$-$5 \times 10^6$ viable cells/ml. For expression studies, insect cells at a viable cell concentration of $1$-$2 \times 10^6$ cells/ml were infected at a multiplicity of infection (MOI) of ≥0.1 units/viable cell. Product levels were monitored in cell pellets, supernatants, and whole broth samples from days 2-6 post-infection. Samples were prepared and analyzed by SDS-PAGE, where TcdA (~300 kDa) and TcdB (~270 kDa) are well separated from most other proteins. Harvest for purification was performed typically on day 4-5 post-infection.

Example 5

Harvest and Purification of TcdA and TcdB Proteins from Insect Cells

TcdA levels in whole broth samples at harvest varied (due to experimental variation and insect cell type differences) from 100-200 mg/l and TcdB levels varied from 200-500 mg/l. Initial efforts were aimed at recovering the product from the clarified supernatant. However, recombinant protein was present both in the supernatant and the cell pellet and can be recovered from either stream or the combined whole broth. The fraction inside cells varied between different insect cell types. Efficient extraction of protein from cell pellet or whole broth required use of non-ionic detergents at concentrations typical for inducing cell lysis (e.g. 0.1-1.0% Triton X-100). For purification, full-length product TcdA was recoverable to greater than 70% purity with low yields from the clarified supernatant using a combination of ammonium sulfate precipitation followed by ion-exchange chromatography (IEX) using a strong anion-exchange resin. Both TcdA and TcdB were recoverable from any of the streams using a combination of IEX chromatography using strong anion-exchange resins followed by Hydroxyapatite (HA) chromatography to >90% purity with yields >20%.

Example 6

Characterization of Recombinant TcdA and TcdB Proteins

Figure 7:
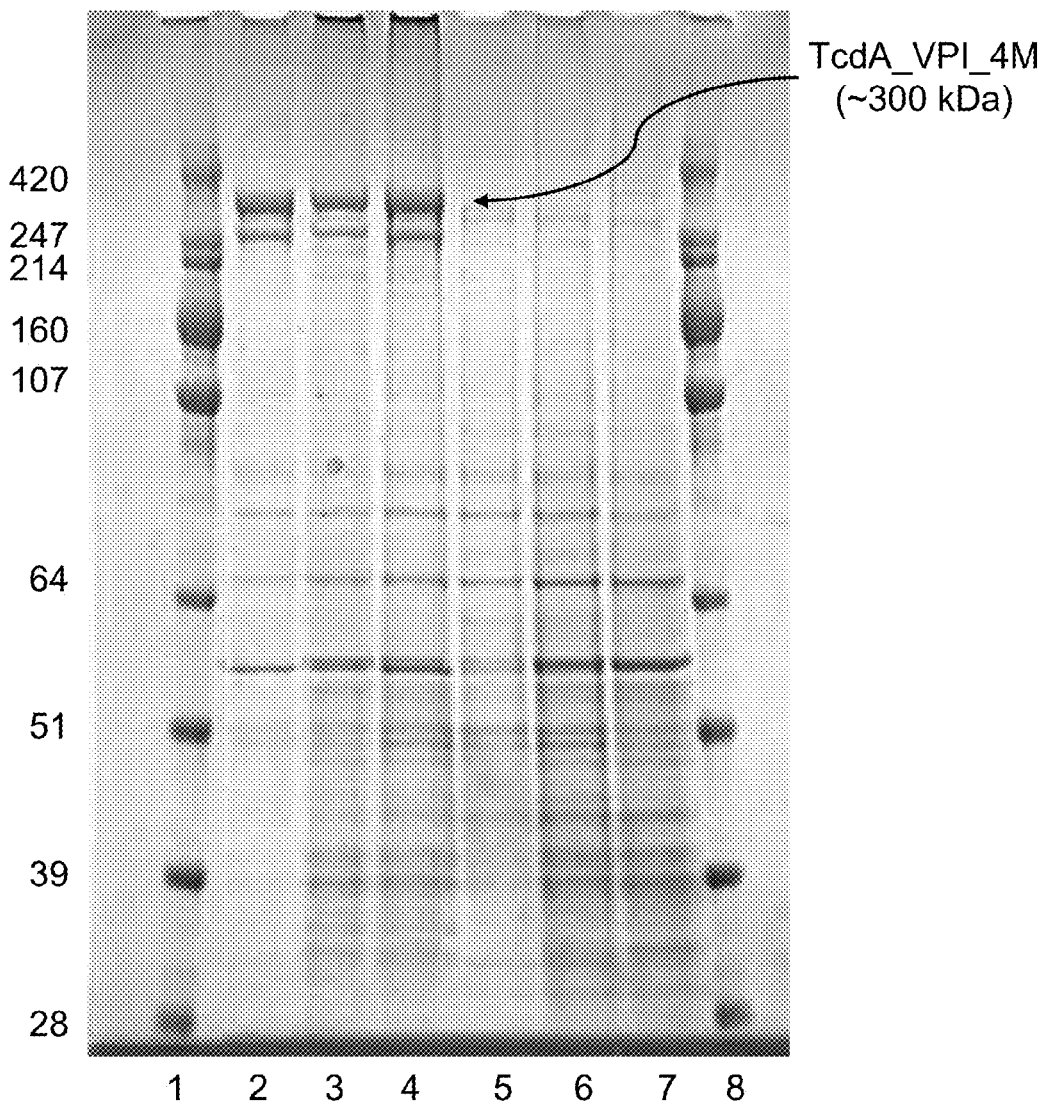
FIG. 7 shows an analysis of supernatant and whole broth samples of TcdA_VPI_4M baculovirus-infected Sf9 insect cells by SDS-PAGE, as described in Example 6. Also shown is baculovirus without an insert (Bacmin), which served as negative control.

The integrity of the TcdA and TcdB protein products (fraction of product related bands that were full length) was best preserved in the baculovirus/insect cell system compared to intracellular expression in *E. coli* (for TcdB) and *B. megaterium*. In addition, the ratio of desired product to host impurities was highest for the baculovirus/insect cell system (due to lower biomass and good per cell productivity) thereby enabling easier downstream processing. To illustrate this, supernatant, and whole broth samples of TcdA_VPI_4M baculovirus-infected Sf9 (ATCC, Manassas, Va.) insect cell culture were analyzed by SDS-PAGE (NuPAGE Novex 4-12% Bis-Tris gels) using 4×LDS as sample buffer (Invitrogen) as shown in FIG. 7. As negative control, baculovirus without an insert (Bacmin) was used. Cells were infected at an MOI of 0.1 $TCID_{50}$ units/cell and harvested five days post-infection.

Results indicated that the mutant toxin material produced by the Baculovirus system was of higher quality than the protein produced in the other systems. It exhibited much less degradation and was more easily purified.

Example 7

Evaluation of TcdA and TcdB Mutant Protein Immunogenicity in a Hamster Challenge Model The hamster model was performed in the following way. Syrian hamsters were immunized four times with vaccine intramuscularly at three-week intervals. Then, following a rest period of 15 days, animals were administered clindamycin (Cleocin) by oral gavage. It was found that this treatment disrupts the colonic microbiota and provides a window of susceptibility to colonization by *C. difficile*. The animals were challenged, five days after Cleocin treatment, with a lethal dose of *C. difficile* spores. Animals were evaluated twice daily for a period of 14-days. Results of protection in this model following immunization with various TcdA and TcdB proteins are provided in FIG. 8.

The recombinant mutant toxins (*E. coli, B. megaterium* and Baculovirus/insect cells) were also shown to be immunologically similar to each other and to a toxoid vaccine made by formaldehyde inactivation of native toxin, in the hamster lethal challenge model, by ELISA measuring serum IgG to native toxin and in a cell based neutralizing antibody assay (Data not shown)

Example 8

Expression of CDTa and CDTb

All binary toxin constructs were generated using a NAP1/027/BI sequence as the template. Since CDTa and CDTb sequences are >97% conserved across all strains examined so far, the selected constructs based on the NAP1 strain should generate sufficient antibody responses to protect against all binary toxin-expressing strains.

The nucleotide sequence encoding CDTa (minus the codons encoding the first 42 N-terminal amino acids which act as a signal peptide) was codon optimized by Genscript (Genscript USA, Inc., Piscataway, N.J.) for optimal expression in *E. coli* (SEQ ID NO:47) and contained flanking NdeI and XhoI cloning sites and no stop codon. The sequence contained an extra methionine at the N-terminus due to an ordering error. The gene was cloned into the NdeI/XhoI sites of the *E. coli* expression vector pET30a (EMD Biochemicals USA, Gibbstown, N.J.) and expressed with a C-terminal 6× histidine tag. Expression studies were performed using the *E. coli* expression host BLR(DE3) (EMD Biochemicals). CDTa was highly expressed and soluble.

Initially, an attempt was made to express the mature form of CDTb (minus signal peptide and activation domain) in *E. coli* with a 6× histidine tag. CDTb was codon optimized for expression in *E. coli* by Genscript with flanking NdeI/XhoI cloning sites and no stop codon (SEQ ID NO:53). The gene was cloned into the NdeI/XhoI sites of the *E. coli* expression vector pET30a and expressed with a C-terminal 6× histidine tag. Expression studies were performed using the *E. coli* expression host BLR(DE3). Unfortunately this construct proved to be unstable and insoluble. >90% of the CDTb protein was found in a degradation product of ~40 kD.

The stable expression of CDTb as a GST fusion protein using the vector pGEX 6P-1 (GE Healthcare) was previously described by Sundriyal et al. (*Protein Expression and Purification* 74: 42-48 (2010)). Based on this study, the Genscript optimized CDTb described above was PCR amplified with primers designed to change the N-terminal cloning site from NdeI to BamHI and to reintroduce the stop codon. CDTb was then cloned into the *E. coli* expression vector pGEX 6P-1 in frame with an N-terminal GST tag as described by Sundriyal (SEQ ID NO:54). CDTb was expressed using BLR(DE3). The fusion protein was stable, highly expressed and soluble. However, proteolytic cleavage to remove the GST tag resulted in greatly reduced solubility of the protein.

In order to try to increase the solubility of CDTb, a second version of CDTb was constructed. This construct, named proCDTb, included the activation domain excluded in the original CDTb construct but still lacked the signal peptide. proCDTb was codon optimized for expression in *E. coli* by Genscript with flanking BamHI and XhoI cloning sites and a stop codon (SEQ ID NO:56). proCDTb was cloned into the expression vector pGEX 6P-1 as described above. Expression studies were performed using the expression host BLR(DE3). The fusion protein was stable, highly expressed and soluble. Again, proteolytic cleavage to remove the GST tag resulted in greatly reduced solubility of the protein.

Hamster studies were performed to assess the safety of the binary toxin components. Hamsters were immunized with CDTb in combination with one of the following forms of CDTa: (1) formaldehyde inactivated recombinant native (no mutations) CDTa, (2) formaldehyde inactivated 3mCDTa1/3mCDTa2, or (3) recombinant 3mCDTa1/3mCDTa2 (no formaldehyde inactivation). Animals were observed were observed for several days post immunization for both systemic and injection site adverse events (AE's). In one study, significant AE's were observed in all arms containing the formaldehyde inactivated wild type sequence CDTa, and few and mild AE's were observed in arms containing the formaldehyde inactivated 3mCDTa1 and 3mCDTa2. In a second study, significant AE's were observed in half of the arms (2/4) receiving the formaldehyde inactivated wild-type sequence CDTa and again few and mild AE's were observed in arms containing the formaldehyde inactivated 3mCDTa1 and 3mCDTa2 and recombinant 3mCDTa1/3mCDTa2 (not formaldehyde inactivated). Results of the studies indicate that the formaldehyde inactivation protocol alone was insufficient to fully inactivate binary toxin. Additionally, the AE's could be mostly attributed to the CDTa component as immunization of the two components separately yielded only minor AE's associated with CDTb.

Example 9

Expression of Genetically Inactive CDTa Proteins

Because binary toxin is an active toxin, it was also desirable to create a genetically inactivated version of the toxin protein. The enzymatic component of the toxin, CDTa, was thus targeted for genetic inactivation. Initially, two triple mutant variants of CDTa were designed to attempt to genetically inactivate CDTa: 3mCDTa1 (R302A, E385A, E387D) and 3mCDTa2 (S345F, E385Q and E387Q). Again the genes were codon optimized by Genscript for optimal expression in *E. coli* in a similar manner to CDTa (above), but without the extra methionine. 3mCDTa1 and 3mCDTa2 were also cloned and expressed as described above for CDTa. 3mCDTa1 and 3mCDTa2 were highly expressed and soluble.

Figure 22:
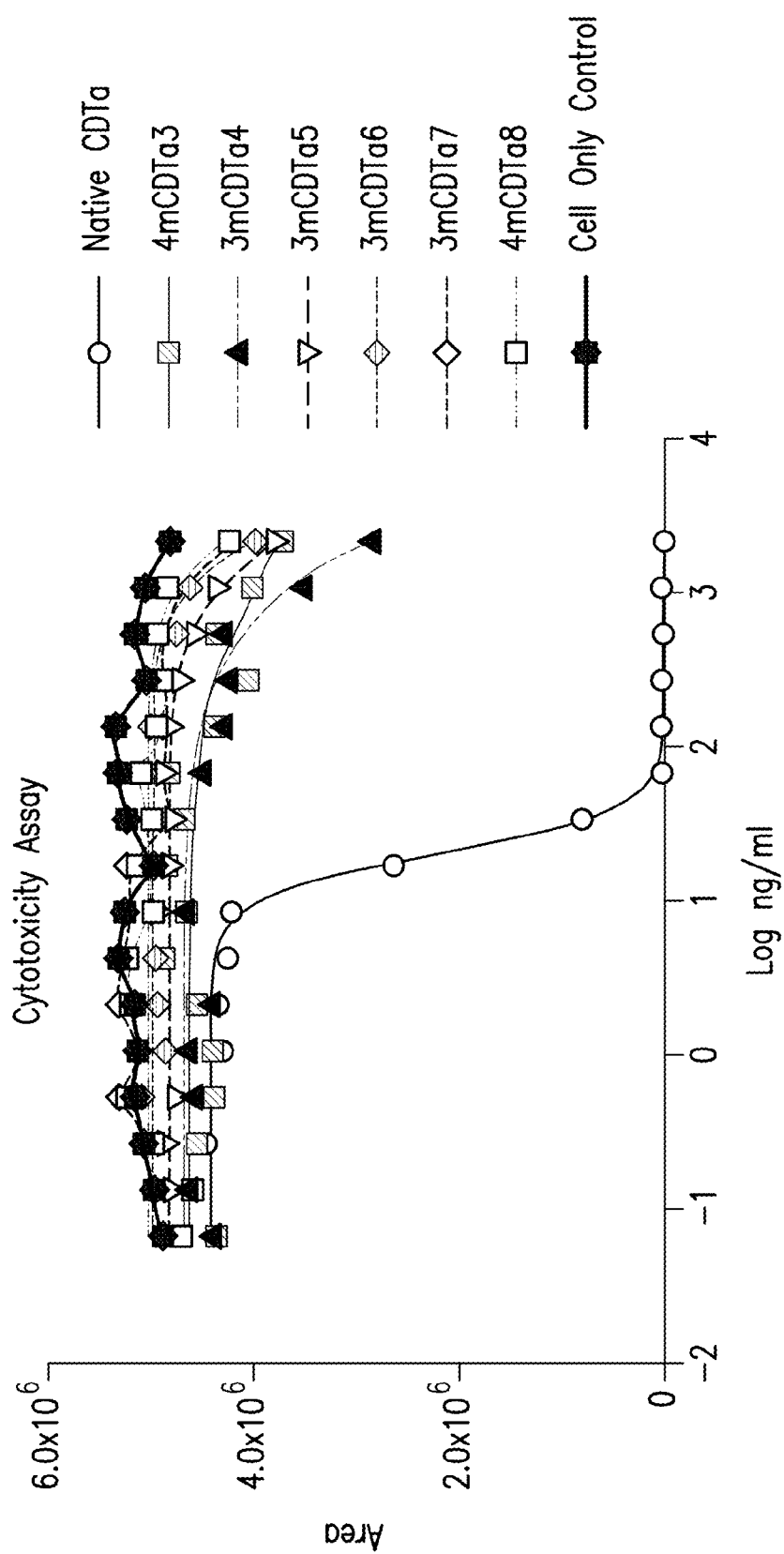
FIG. 22 provides results of a cytotoxicity assay of various mutant forms of CDTa mixed with chymotrypsin-activated proCDTb on Vero cells compared to native CDTa, as described in Example 9.

An additional three triple mutant variants of CDTa and two quadruple mutant variants of CDTa were designed to genetically inactivate CDTa: 4mCDTa3 (R302A, S345F, E385Q, E387Q); 3mCDTa4 (Y62A, Y69A, R255A); 3mCDTa5 (R359A, Y62A, Q307E); 3mCDTa6 (Y258A, F356A, S345F); 3mCDTa7 (N342A, Y253A, Y382A); and 4mCDTa8 (S345F, E385Q, E387Q, C2A). Cytotoxicity studies were performed to compare the toxicity of the mutant constructs to the native antigen. In the toxicity titration assay, CDTa (native or mutant) and activated CDTb were combined at a 1:7 CDTa:CDTb Molar ratio. Toxin mixtures were serially diluted in complete MEM medium. Diluted toxins were then applied to Vero cells grown in 384 well plates and incubated in a humidified $CO_2$ incubator at 37° C. for 24 hours. The cells were fixed, permeabilized, and stained with Alexa 488 phalloidin and an image of the monolayer was acquired using a scanning cytometer (ImageXpress Velos). The titration curve was graphed using GraphPad Prism software. Results indicate that less toxicity was observed for all mutant CDTa proteins v. native CDTa (see FIG. 22).

Example 10

Purification of CDTa/CDTb

To obtain purified binary toxin proteins for use in animal studies, CDTa and CDTb were purified from *E. coli* as affinity-tagged antigens. Purification processes using affinity columns were optimized to deliver sufficient yield and purity for animal studies. Table 1 describes the affinity tag used for purification of each construct, and the yield and purity obtained. Additional purification steps beyond affinity chromatography were used in some cases to achieve sufficient purity for further studies.

TABLE 1

Purification summary for affinity-tagged binary toxin antigens.

| | | Purified Toxin Attributes | |
| --- | --- | --- | --- |
| Construct | Affinity Tag Used | Yield (Purified; per liter fermentation) | Purity |
| Native CDTa | His-tag | 6 mg/L | >95% |
| 3mCDTa | His-tag | 23 mg/L | >95% |
| CDTb | GST-tag | 16 mg/L | ~90% |
| ProCDTb | GST-tag | 17 mg/L | >95% |

Additionally, untagged binary toxin proteins were expressed in *Bacillus megaterium* and in insect cells using baculovirus vectors. Expression titers from each system were determined by SDS-PAGE. Expression titers for 3mCDTa (measured from whole lysate/culture broth) were >1 g/L for *B. megaterium* and approximately 0.3 g/L for the baculovirus system. Expression titers for CDTb were 0.02 g/L for *B. megaterium* and 0.2 g/L for baculovirus. For ProCDTb, expression titers were >0.5 g/L in baculovirus.

Example 11

Efficacy of Vaccine Compositions

Figure 11B:
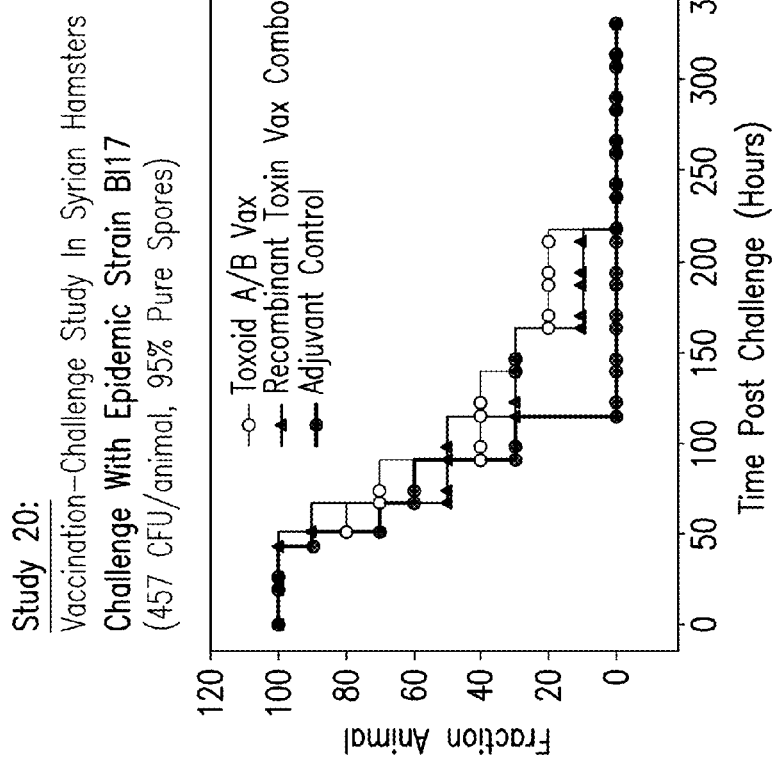
FIG. 11 shows survival curves for studies performed in a hamster challenge model as described in Example 11 (percent survival over time). Hamsters were vaccinated with either a combination of nap_4mTcdA and nap_4mTcdB (black triangles), or formaldehyde-inactivated toxoid A and toxoid B (white circles), both formulated on MAA with ISCOMATRIX® adjuvant. Also shown is the adjuvant-only control (black circles). Animals were challenged with 241 CFU of prototypic strain VPI10463 (panel A) or with 457 CFU of epidemic strain NAP1/027/BI17 (panel B).
Figure 11A:
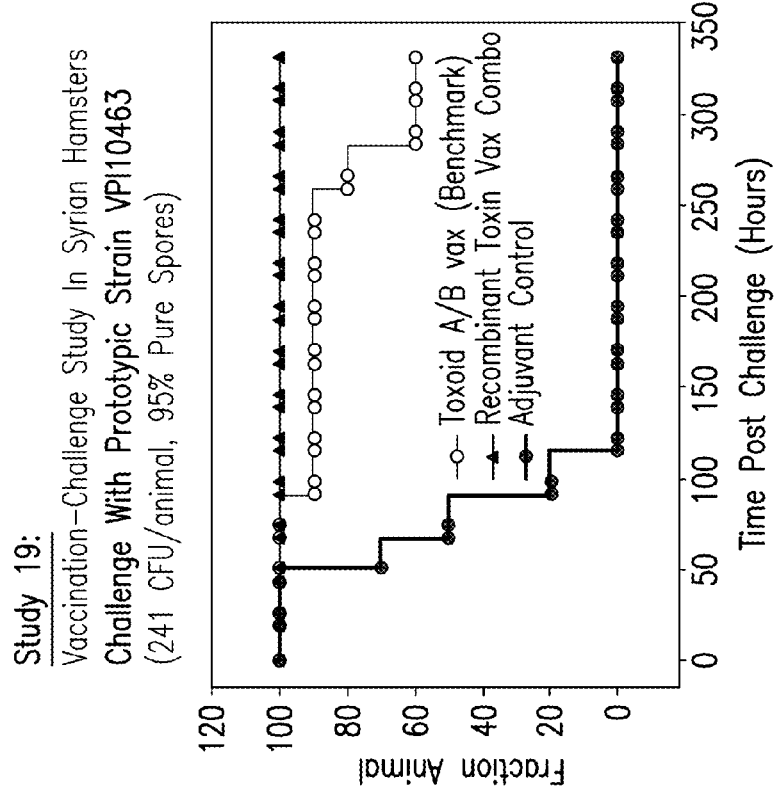

The efficacy of vaccine compositions comprising binary toxins was assessed in the hamster model as described in Example 7. In one study, hamsters were immunized with vaccines comprising either (a) recombinant TcdA (Nap_3mTcdA, produced using the *Bacillus megaterium* expression system) and TcdB (Nap_3mTcdB, produced using the *Bacillus megaterium* expression system), formulated with aluminum hydroxyphosphate adjuvant ("Merck Aluminum Adjuvant" or "MAA") and ISCOMATRIX® adjuvants, (b) formaldehyde-inactivated TcdA and TcdB (List Biological Laboratories, Inc., Campbell, Calif.) formulated with MAA and ISCOMATRIX®, or (c) adjuvant-only control. Results indicate that animals who received the recombinant vaccine were fully protected from a 241 CFU/dose lethal challenge of spores (95% pure) from prototypic VPI10463 strain (FIG. 11, panel A).

However, despite the fact that these animals survived challenge with the VPI strain, substantial weight loss, diarrhea and morbidity occurred among the animals in all test groups. Additionally, *C. difficile* bacteria and toxin could be detected both in feces and cecal content. Furthermore, in a separate study comparing vaccination with the same three test groups ((a)-(c)) described above, the recombinant TcdA+TcdB vaccine was unable to substantially increase the survival of hamsters challenged with 457 CFU dose lethal challenge of spores (95% pure) from a highly virulent NAP1/027/BI17 strain (FIG. 11, panel B).

Therefore, additional vaccine components were evaluated to determine if other antigens could be added to the vaccine to increase the protective efficacy of the vaccine and to reduce the morbidity associated with the disease. To this end, literature and proteomic evaluations were performed to identify nine additional antigens that may possibly be added to the TcdA and TcdB toxins in the vaccine and such additional antigens were assessed in the hamster model in combination with TcdA and TcdB. From this assessment, it was determined that addition of binary toxin (CDTa and CDTb) to the vaccine containing TcdA and TcdB consistently increased the protective efficacy of this vaccine in hamsters following NAP1/027/BI challenge.

Figure 12:
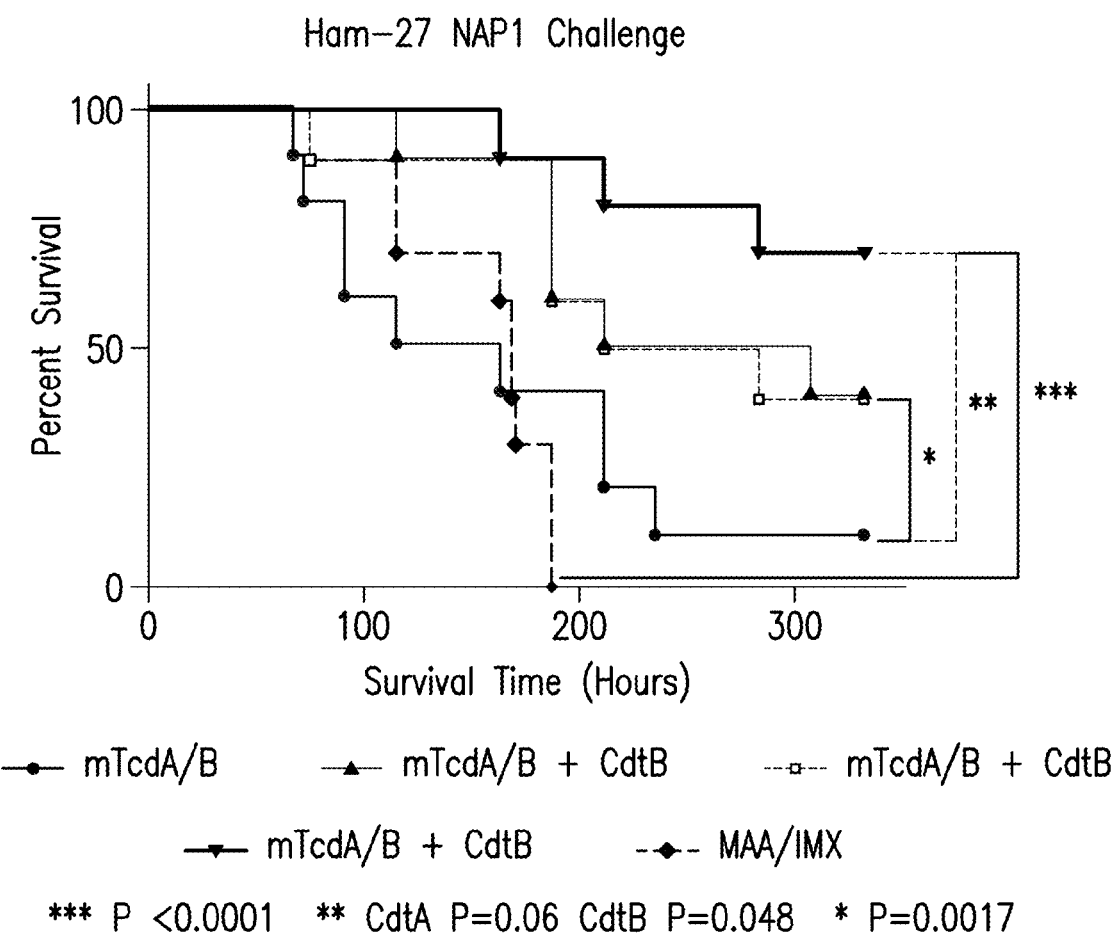
FIG. 12 shows the relevant contributions of CDTa and CDTb on protective efficacy of a *C. difficile* vaccine following challenge with a NAP1/027/BI17 strain in a hamster challenge model.

We also investigated in a hamster challenge study whether both components of binary toxin (CDTa and CDTb) were required for the protection mediated by this molecule or whether one protein would suffice. In this study, hamsters were vaccinated with either (a) recombinant TcdA (5mTcdA, produced using the baculovirus expression system), recombinant TcdB (5mTcdB, produced using the baculovirus expression system), and CDTa; (b) recombinant TcdA (5mTcdA, produced using the baculovirus expression system), recombinant TcdB (5mTcdB, produced using the baculovirus expression system), and CDTb; or (c) recombinant TcdA (5mTcdA, produced using the baculovirus expression system), recombinant TcdB (5mTcdB, produced using the baculovirus expression system), CDTa, and CDTb. All groups (a)-(c) were formulated with MAA and ISCOMATRIX adjuvants and compared to a fourth group (d) that received only adjuvants. The results suggest that either CDTa or CDTb in combination with TcdA and TcdB could induce protection from lethal challenge by a NAP1/027/BI17 strain (470 CFU/animal), however, this protection was incomplete. In contrast, the combination of both binary toxin proteins (CDTa and CDTb) with TcdA and TcdB fully restored the protection observed in previous studies using this combination (FIG. 12).

Example 12

Immunogenicity of Vaccine Compositions in Non-Human Primates

Eleven groups of 4-10 year-old rhesus monkeys (n=3 per group) were immunized intramuscularly with different vaccine compositions comprising 20 µg vpi_5mTcdA_bv, 20 µg nap_5mTcdB_bv, 5 µg 3m_CdtA2_bv and 5 µg proCdtB ("Study 11"). Test compositions given to ten groups also comprised an adjuvant selected from IMX, MAA, IMO2170, or combinations of these adjuvants as shown in FIG. 17. IMO2170 is a toll-like receptor agonist obtained from Idera Pharmaceuticals (Cambridge, Mass.).

Animals were monitored for adverse events throughout the study. Temperature was taken by transponder daily on awake animals throughout the study and at 4 hr post-dose 1 (PD1), PD2, PD3 and PD4. Injection sites were observed at post dose 4 hr, and daily for at least 7 days. Temperatures were within the normal range for most monkeys throughout the study. No adverse events were observed at any time points for any animals.

Animals were bled at designated time points and the immune response to all four antigens was measured using an ELISA assay. The concentration of serum antitoxin IgG induced by vaccination in rhesus monkeys was measured for each vaccine component. Antigens were coated on 96-well plates (TcdA at 1 TcdB at 0.5 μg/ml, CDTa at 5 μg/ml and CDTb at 5 μg/ml). A general ELISA protocol was followed including washing and blocking steps and a HRP goat anti-human IgG Fcg secondary antibody and substrate for development.

Results of the TcdA ELISA assay show that for those groups receiving a three dose schedule, PD-1 antibody titers were below 1:100. PD-2 and PD-3 titers were very similar in groups 1-4 and 6-7. For groups receiving a four dose schedule, after dose 2, antibody titers were only observed in the group that received the vaccine in IMX-MAA (group 11, 1:1863 titer) PD-3 and PD-4 titers were similar in groups 9-10. Additionally, a decline in titer was observed for group 11 PD-4.

For groups receiving a three-dose schedule, results of the TcdB ELISA assay, show that PD-1 antibody titers were below 1:100. PD-2 and PD-3 titers were very similar in groups 2, 4 and 7. A boost (>5×) in titers was observed after the third dose in groups 1, 3, 5, and 6. For groups receiving a four dose schedule, antibody titers were only observed in the group that received the vaccine in IMX-MAA (group 11, 1:8144) PD-2. Titers were similar in groups 9 and 10 PD-3 and PD-4. Following dose 4, a boost in titer was observed for group 1 (~8×) and a decline in titer (2.5×) was observed for group 11.

For the binary toxin components, higher titers overall were observed for CDTb relative to CDTa. For those groups that received a three-dose schedule, PD-1 antibody titers for CDTa were below 1:100. Following dose 2, CDTa titers were observed only in group 5 (1:10850). Titers were observed in all groups PD-3, with a maximal titer of 1:26,000 observed in group 5 (IMX-MAA-NoF). Titers of <1:2000 were observed for group 6 (IMO-MAA-F) and group 7 (no adjuvant). CDTa titers for all groups that received a four dose schedule were undetectable until after dose 2. Following dose 3, a boost in titer was observed in groups 8-10 and a decline in titer was observed in group 11.

For CDTb, PD-1 antibody titers were below 1:100 for all groups that received a three dose schedule. Antibody titers PD-2 and PD-3 were high in all groups that received a three-dose schedule. Interestingly there was a boost (5×) in titers in the group (Group 7) that received the vaccine without adjuvant. For groups receiving a four-dose schedule, low antibody titers were observed PD-2 compared with the PD-2 titers from the 3 dose schedule groups. However, PD-3 and PD-4 titers were very similar in all groups. Final IgG ELISA titers (day

Figure 18A:
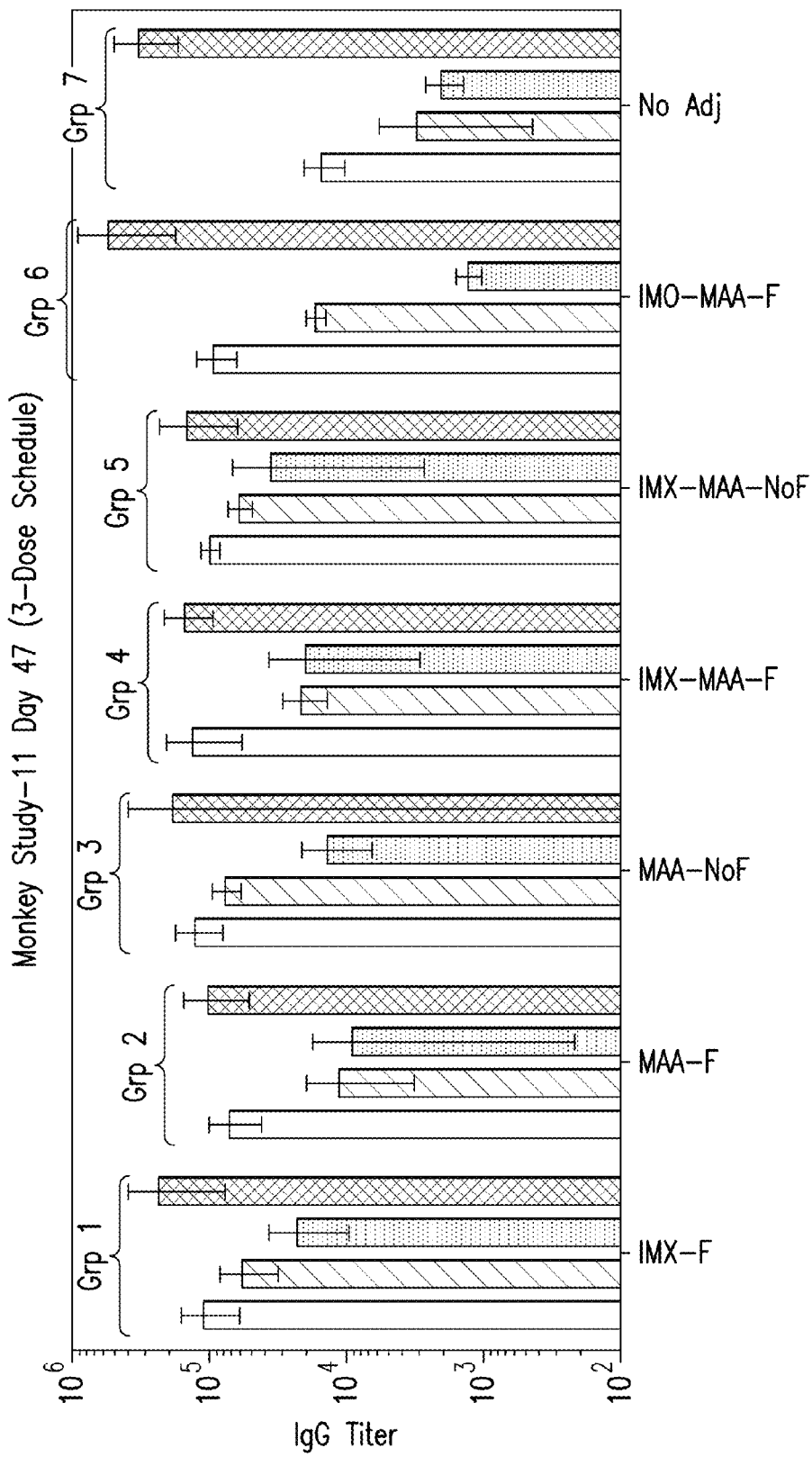
FIG. 18 shows results of ELISA assays for IgG titers to TcdA, TcdB, CDTa, and CDTb for different groups of monkeys (Study #11) that received vaccine compositions comprising each of the four components in combination with various adjuvants as shown in a three dose schedule (FIG. 18A) or a four dose schedule (FIG. 18B).
Figure 18B:
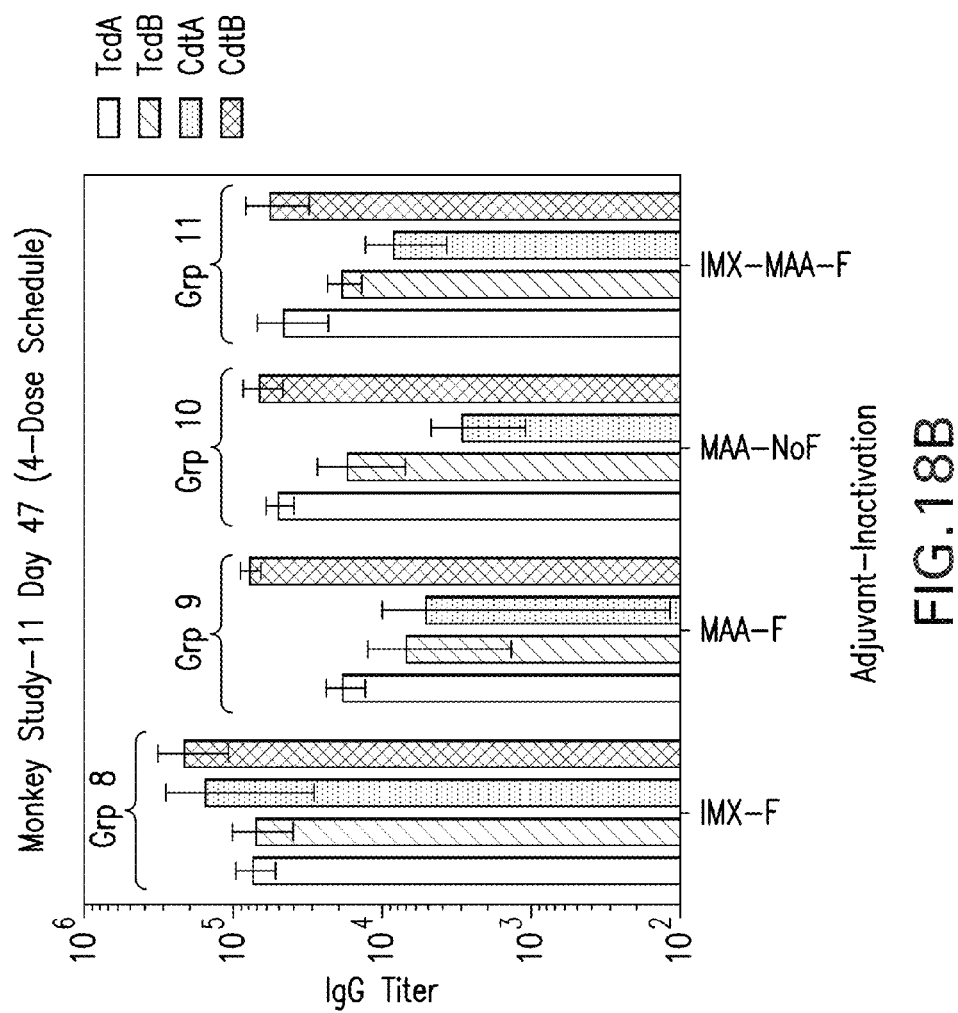

47) are provided in FIG. 18A for groups receiving a three-dose schedule and FIG. 18B for groups receiving a four-dose schedule.

Figure 19A:
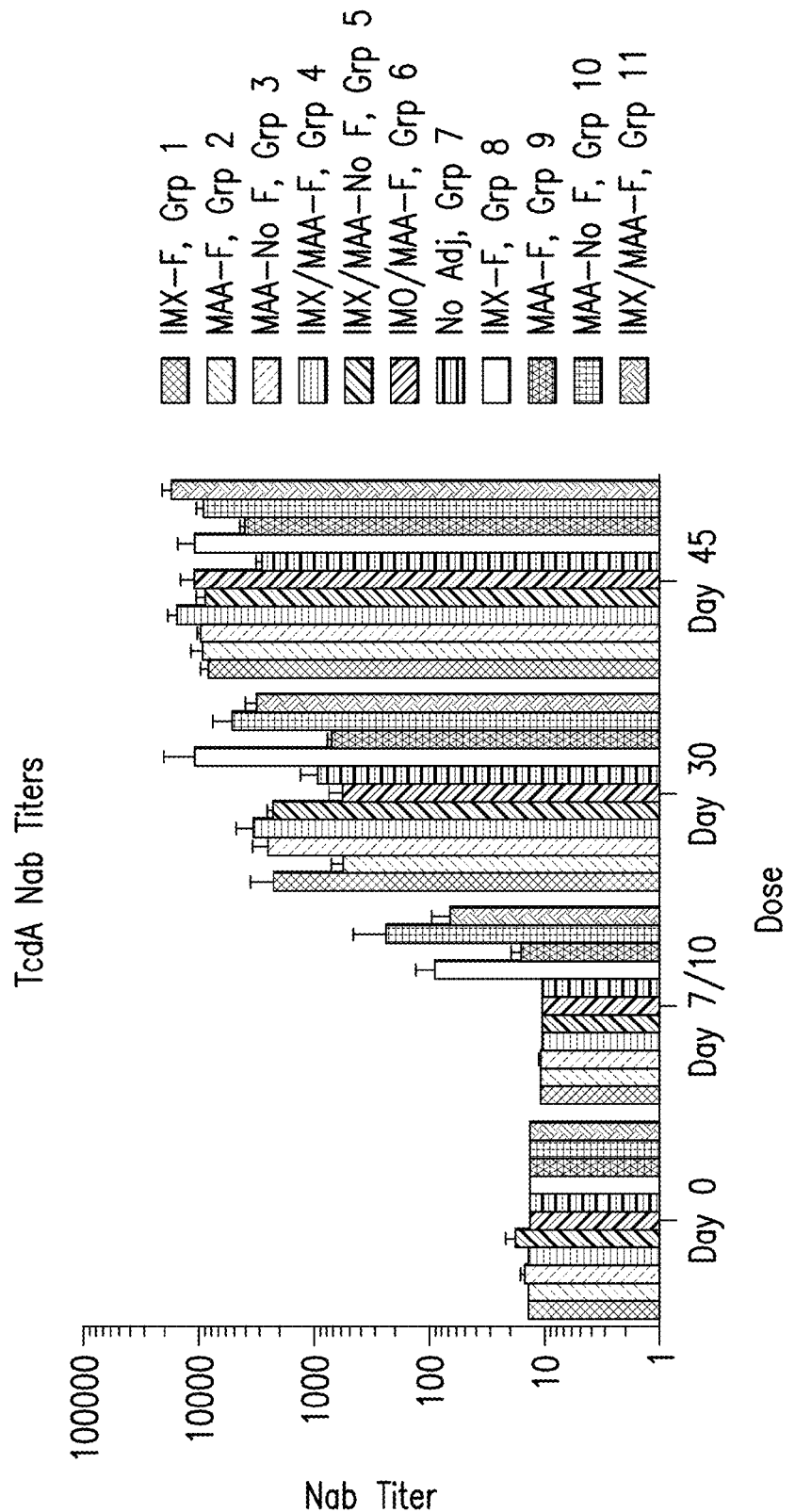
Figure 19B:
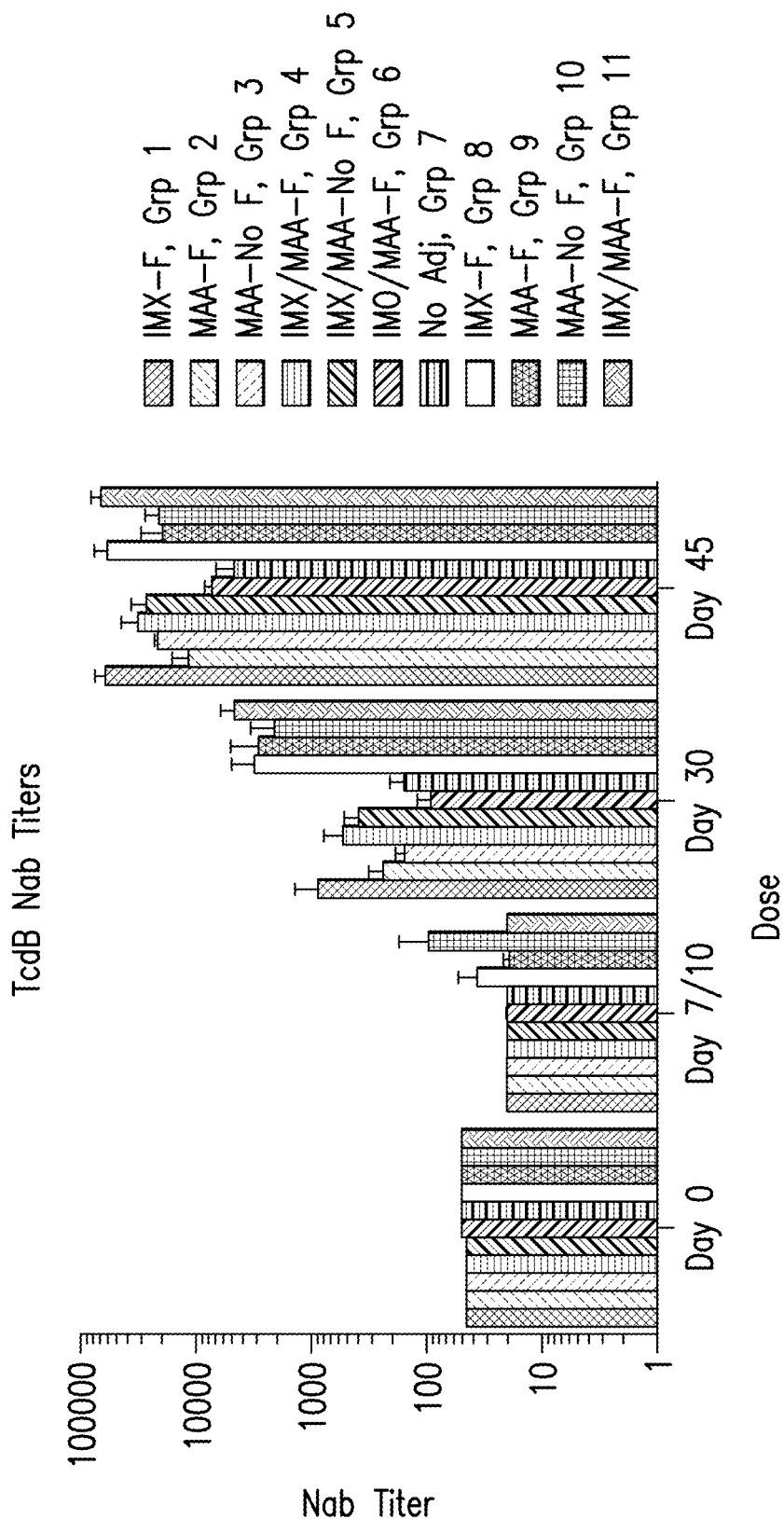
Figure 19C:
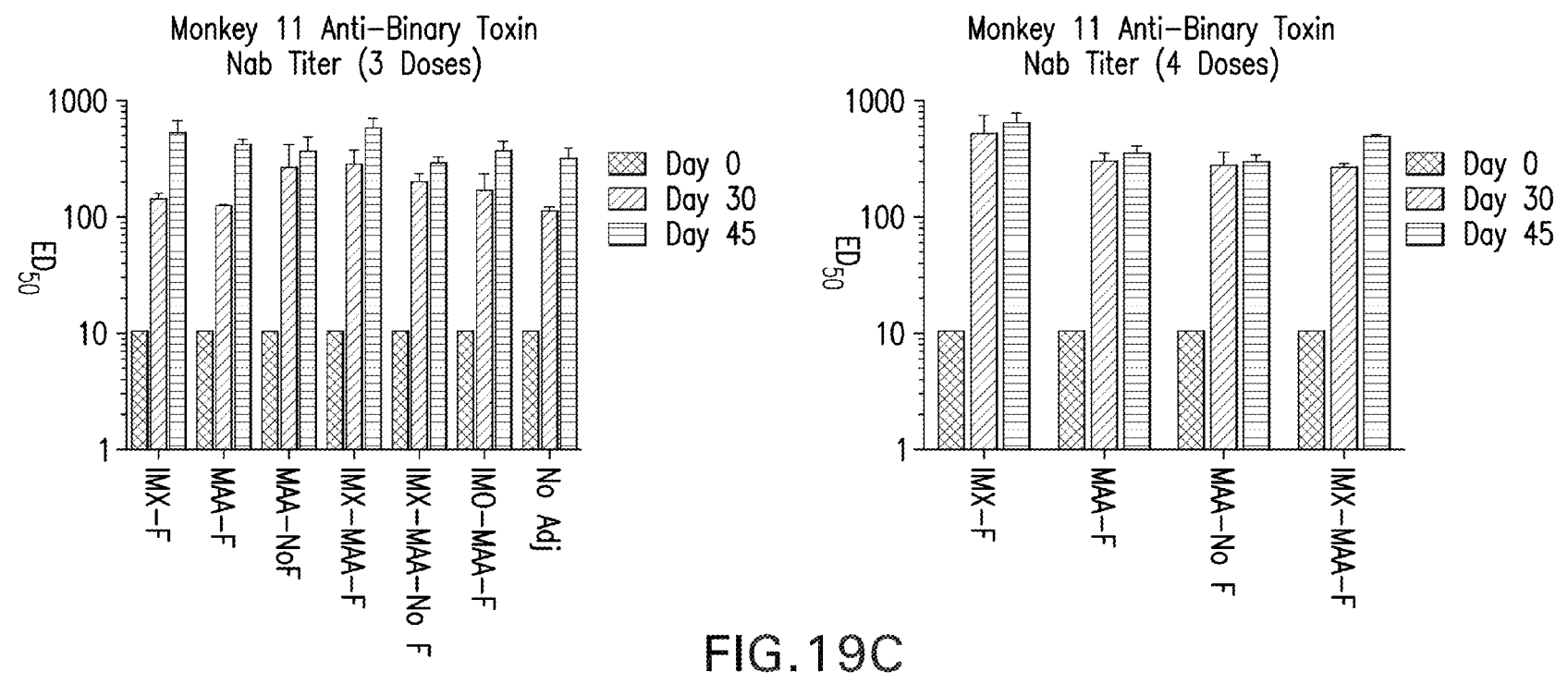

Neutralizing antibodies were also measured using a Nab assay. In this assay, the ability of antisera to inhibit killing of Vero cells by native TcdA or TcdB was assessed. Following incubation of toxin and dilutions of antisera with Vero cells, cells were fixed and stained with a fluorescent probe specific for F-actin. The amount of F-actin stained and subsequent cell areas was determined using a cell-scanning cytometer. Results indicate that neutralizing antibodies to TcdA and TcdB were observed in all groups after 30 days (PD-3) and 45 days (PD-3 or PD-4, depending on group). For the three dose schedule at day 45, Group 4 (IMX/MAA-F) had the highest neutralizing antibody titers to both TcdA and binary toxin; Group 1 (IMX-F) had the highest neutralizing titers to TcdB. Day 45 results from the four dose schedule show Groups 8 and 11 (IMX-F and IMX/MAA-F) to have higher titers compared to the MAA adjuvanted (Groups 9 and 10) in all three neutralization assays. In general, monkeys immunized with the four component vaccine, adjuvanted with IMX or IMX/MAA had the highest neutralizing titers. Results of the Nab assays are provided in FIGS. 19A-19C.

Example 13

Analytical and Immunogenicity Analysis of CDTa Mutant 4mCDTa8

Through Western blot analysis of recombinant mutant 3mCDTa2 and recombinant wild type CDTa, we observed that these CDTa proteins had a tendency to dimerize. 8-16% Tris-Glycine gels were loaded with 5 µg or 2 µg per well and run under reducing and non-reducing conditions. See FIG. 20A. Results indicated that under reducing conditions, both CDTa and 3mCDTa2 proteins were present mostly as a monomer (>97%). However, under non-reducing conditions, approximately 35-38% of CDTa and approximately 60-63% of 3mCDTa2 was present as a dimer.

By examining the sequence of CDTa, we discovered a single cysteine residue (C2), which we mutated to try to reduce or eliminate the dimerization of CDTa since cysteines can cause proteins to oligomerization through disulfide bonds. We thus made 4mCDTa8, in which we added the mutation C2A to the mutations in 3mCDTa2. SEC analysis was performed to confirm if the cysteine mutation was in fact reducing dimerization. For SEC-UV analysis of 3mCDTa1, the mobile phase was 25 mM NaPi, 0.3 M NaCl, 0.05% w/v sodium azide, pH 6.8 and the analysis was performed using a TSKgel super SW3000 (Tsosoh Bioscience 18675) with a flow rate of 0.2 ml/min. For SEC-MALS analysis of 4mCDTa8, the sample was injected onto a Wyatt 010S5 analytical with a guard column. The column was equilibrated and run in PBS at 0.5 ml/min. The sample eluted as a single well-defined peak with a calculated molecular weight of approximately 56.9 kDa which is about 13% higher than the sequence-predicted monomer molecular weight.

Figure 20B:
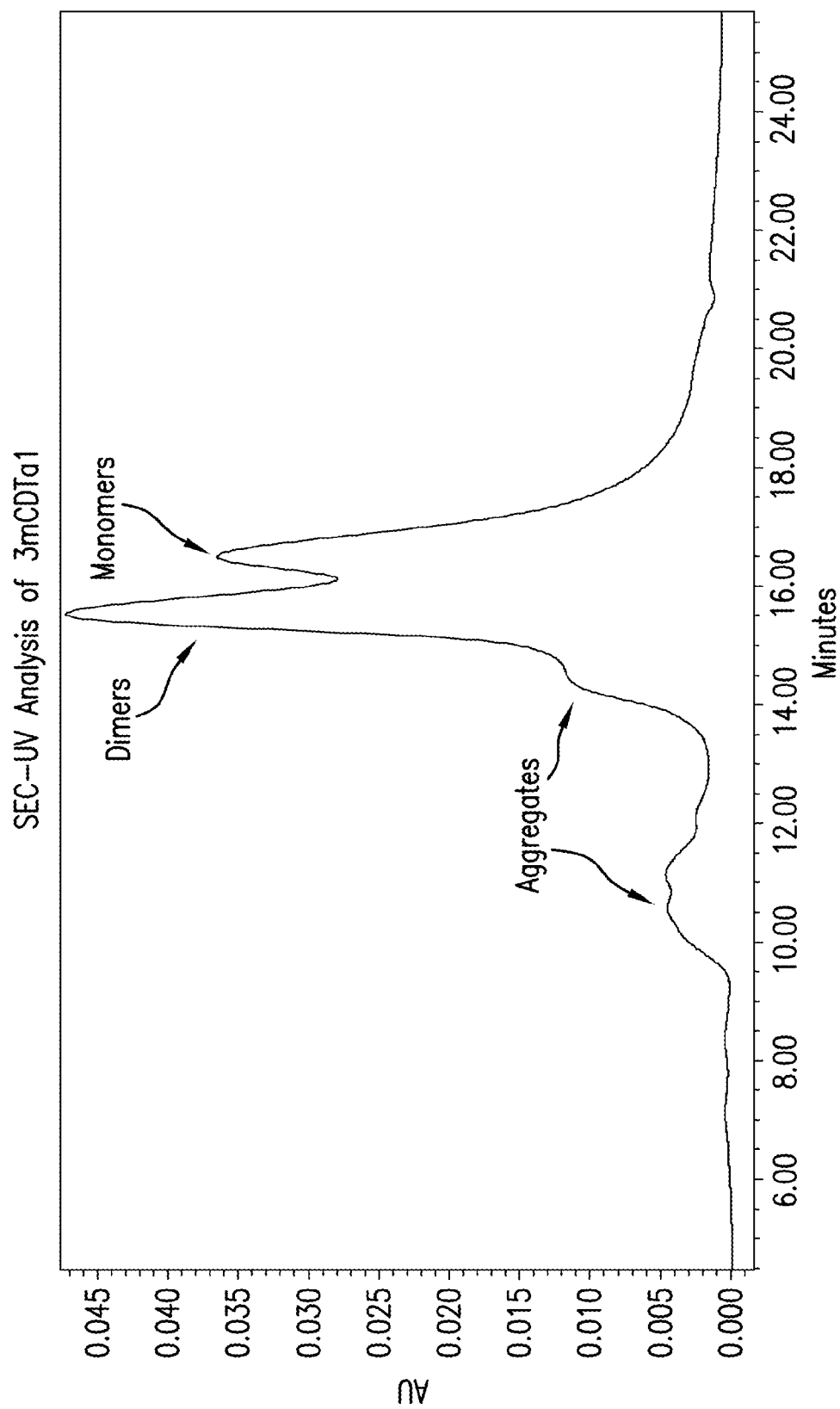
FIG. 20B shows the results of SEC-UV analysis of 3mCDTa1 over time. Peaks are shown for aggregates, dimers and monomers.
Figure 21:
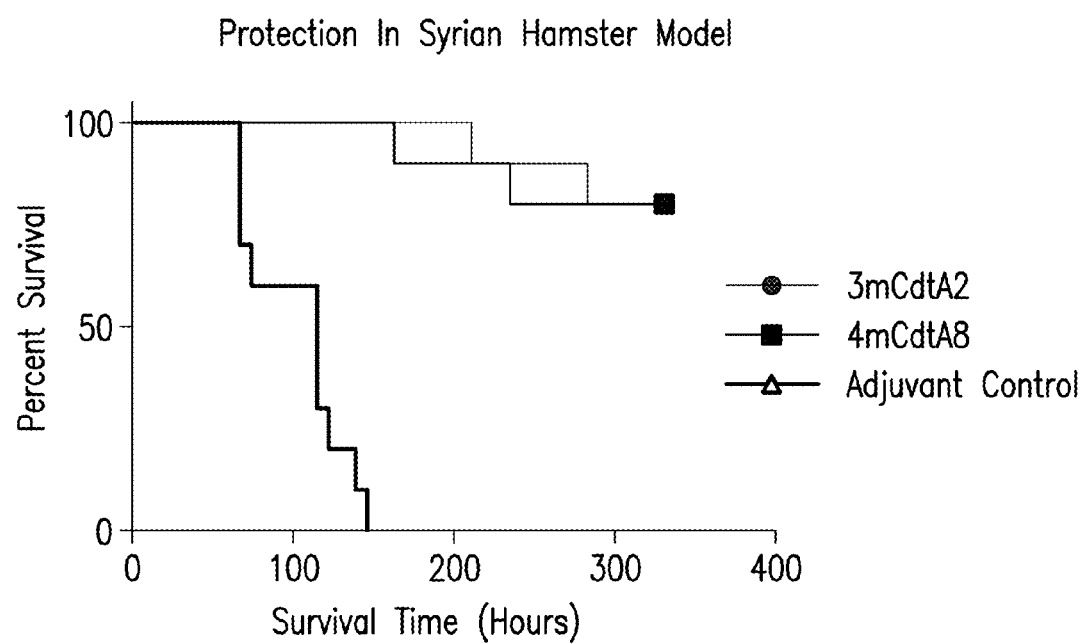
FIG. 21 shows a comparison of protection of Syrian hamsters which were immunized with either 3mCDTa2 or 4mCDTa8. Shown is percent survival over time, compared to an adjuvant only control.

SEC-UV analysis of 3mCDTa1 confirmed that a higher percentage of the material is present as a dimer/higher aggregate versus monomer (see FIG. 20B). In contrast, SEC-MALs analysis of 4mCDTa8 showed that protein material was present almost exclusively as a monomer (FIG. 20C), confirming that the cysteine mutation did dramatically decrease the oligomerization of CDTa.

To determine if the C2A mutation affected the immunogenicity or the ability of the CDTa protein component to provide protection following a NAP1 challenge, a hamster study was performed which included a comparison of the immunogenicity of 3mCDTa 2 and 4mCDTa8 in combination with other vaccine components (mutant TcdA/B, proCDTb). The survival curves showed that in both groups 80% of the hamsters survived the NAP1 challenge, indicating that adding the cysteine mutation did not adversely affect the immunogenicity of 3mCDTa2 (both antigens are immunologically similar).

SEQUENCE LISTING (102 sequences)

SEQ ID NO: 1 - DNA, 8160 bp, Artificial Sequence
  VPI 10463 strain, W101A, D287A, E514Q TcdA (Tri, contains E. coli-optimized CROPs fragment)
atgggatctttaatatctaaagaagagttaataaaactcgcatatagcattagaccaagagaaaatgagtataaaactatactaactaatttagacgaatataataagttaactacaaacaataatgaaaataaatatttgcaattaaaaaaactaaatgaatcaattgatgtttttatgaataaatataaaacttcaagcagaaatagagcactctctaatctaaaaaaagatatattaaaagaagtaattcttattaaaaattccaatacaagccctgtagaaaaaaatttacattttgtagcgataggtggagaagtcagtgatattgctcttgaatacataaaacaatgggctgatattaatgcagaatataatattaaactgtggtatgatagtgaagcattcttagtaaatacactaaaaaaggctatagttgaatcttctaccactgaagcattacagctactagaggaagagattcaaaatcctcaatttgataatatgaaattttacaaaaaaaggatggaatttatatatgatagacaaaaaaggtttataaattattataaatctcaaatcaataaacctacagtacctacaatagatgatattataaagtctcatctagtatctgaatataatagagatgaaactgtattagaatcatatagaacaaattctttgagaaaaataaatagtaatcatgggatagatatcagggctaatagtttgtttacagaacaagagttattaaatatttatagtcaggagttgttaaatcgtggaaatttagctgcagcatctgacatagtaagattattagccctaaaaaattttggcggagtatatttagatgttgctatgcttccaggtattcactctgatttatttaaaacaatatctagacctagctctattggactagaccgttgggaaatgataaaattagaggctattatgaagtataaaaaatatataaataattatacatcagaaaactttgataaacttgatcaacaattaaaagataattttaaactcattatagaaagtaaaagtgaaaaatctgagatattttctaaattagaaaatttaaatgtatctgatcttgaaattaaaatagctttcgctttaggcagtgttataaatcaagccttgatatcaaaacaaggttcatatcttactaacctagtaatagaacaagtaaaaaatagatatcaatttttaaaccaacaccttaacccagccatagagtctgataataacttcacagatactactaaaatttttcatgattcattatttaattcagctaccgcagaaaactctatgtttttaacaaaaatagcaccatacttacaagtaggttttatgccagaagctcgctccacaataagtttaagtggtccaggagcttatgcgtcagcttactatgatttcataaatttacaagaaaatactatagaaaaaactttaaaagcatcagatttaatagaatttaaattcccagaaaataatctatctcaattgacagaacaacaaataaatagtctatggagctttgatcaagcaagtgcaaaatatcaatttgagaaatatgtaagagattatactggtggatctctttctgaagacaatggggtagactttaataaaaatactgccctcgacaaaaactatttattaaataataaaattccatcaaacaatgtagaagaagctggaagtaaaaattatgttcattatatcatacagttacaaggagatgatataagttatgaagcaacatgcaatttattttctaaaaatcctaaaaatagtattattatacaacgaaatatgaatgaaagtgcaaaaagctactttttaagtgatgatggagaatctattttagaattaaataaatataggatacctgaaagattaaaaaataaggaaaaagtaaaagtaacctttattggacatggtaaagatgaattcaacacaagcgaatttgctagattaagtgtagattcactttccaatgagataagttcatttttagataccataaaattagatatatcacctaaaaatgtagaagtaaacttacttggatgtaatatgtttagttatgattttaatgttgaagaaacttatcctgggaagttgctattaagtattatggacaaaattacttccactttacctgatgtaaataaaaattctattactataggagcaaatcaatatgaagtaagaattaatagtgagggaagaaaagaacttctggctcactcaggtaaatggataaataaagaagaagctattatgagcgatttatctagtaaagaatacattttttttgattctatagataataagctaaaagcaaagtccaagaatattccaggattagcatcaatatcagaagatataaaaacattattacttgatgcaagtgttagtcctgatacaaaatttattttaaataatcttaagcttaatattgaatcttctattggggattacatttattatgaaaaattagagcctgttaaaaatataattcacaattctatagatgatttaatagatgagttcaatctacttgaaaatgtatctgatgaattatatgaattaaaaaaattaaataatctagatgagaagtatttaatatcttttgaagatatctcaaaaaataattcaacttactctgtaagatttattaacaaaagtaatggtgagtcagtttatgtagaaacagaaaaagaaattttttcaaaatatagcgaacatattacaaaagaaataagtactataaagaatagtataattacagatgttaatggtaatttattggataatatacagttagatcatacttctcaagttaatacattaaacgcagcattctttattcaatcattaatagattatagtagcaataaagatgtactgaatgatttaagtacctcagttaaggttcaactttatgctcaactatttagtacaggtttaaatactatatatgactctatccaattagtaaatttaatatcaaatgcagtaaatgatactataaatgtactacctacaataacagaggggatacctattgtatctactatattagacggaataaacttaggtgcagcaattaaggaattactagacgaacatgacccattactaaaaaaagaattagaagctaaggtgggtgttttagcaataaatatgtcattatctatagctgcaactgtagcttcaattgttggaataggtgctgaagttactattttcttattacctatagctggtatatctgcaggaataccttcattagttaataatgaattaatattgcatgataaggcaacttcagtggtaaactattttaatcatttgtctgaatctaaaaaatatggccctcttaaaacagaagatgataaaattttagttcctattgatgatttagtaatatcagaaatagattttaataataattcgataaaactaggaacatgtaatatattagcaatggaggggggatcaggacacacagtgactggtaatatagatcactttttctcatctccatctataagttctcatattccttcattatcaatttattctgcaataggtatagaaacagaaaatctagatttttcaaaaaaaataatgatgttacctaatgctccttcaagagtgttttggtgggaaactggagcagttccaggtttaagatcattggaaaatgacggaactagattacttgattcaataagagatttatacccaggtaaattttactggagattctatgcttttttcgattatgcaataactacattaaaaccagtttatgaagacactaatattaaaattaaactagataaagatactagaaacttcataatgccaactataactactaacgaaattagaaacaaattatcttattcatttgatggagcaggaggaacttactctttattattatcttcatatccaatatcaacgaatataaatttatctaaagatgatttatggatatttaatattgataatgaagtaagagaaatatctatagaaaatggtactattaaaaaaggaaagttaataaaagatgttttaagtaaaattgatataaataaaaataaacttattataggcaatcaaacaatagatttttcaggcgatatagataataaagatagatatatattcttgacttgtgagttagatgataaaattagtttaataatagaaataaatcttgttgcaaaatcttatagtttgttattgtctggggataaaaattatttgatatccaatttatctaatactattgagaaaatcaatactttaggcctagatagtaaaaatatagcgtacaattacactgatgaatctaataataaatattttggagctatatctaaaacaagtcaaaaaagcataatacattataaaaaagacagtaaaaatatattagaattttataatgacagtacattagaatttaacagtaaagattttattgctgaagatataaatgtatttatgaaagatgatattaatactataacaggaaaatactatgttgataataatactgataaaagtatagatttctctatttctttagttagtaaaaatcaagtaaaagtaaatggattatatttaaatgaatccgtatactcatcttaccttgattttgtgaaaaattcagatggacaccataatacttctaattttatgaatttatttttggacaatataagtttctggaaattgtttgggtttgaaaatataaattttgtaatcgataaatactttacccttgttggtaaaactaatcttggatatgtagaatttatttgtgacaataataaaaatatagatatatattttggtgaatggaaaacatcgtcatctaaaagcactatatttagcggaaatggtagaaatgttgtagtagagcctatatataatcctgatacgggtgaagatatatctacttcactagatttttcctatgaacctctctatggaatagatagatatataaataaagtattgatagcacctgatttatatacaagtttaataaatattaataccaattattattcaaatgagtactaccctgagattatagttcttaacccaaatacattccacaaaaaagtaaatataaatttagatagttcttcttttgagtataaatggtctacagaaggaagtgactttattttagttagatacttagaagaaagtaataaaaaaatattacaaaaaataagaatcaaaggtatcttatctaatactcaatcatttaataaaatgagtatagattttaaagatattaaaaaactatcattaggatatataatgagtaattttaaatcatttaattctgaaaatgaattagatagagatcatttaggatttaaaataatagataataaaacttattactatgatgaagatagtaaattagttaaaggattaatcaatataaataattcattattctattttgatcctatagaatttaacttagtaactggatggcaaactatcaatggtaaaaaatattattttgatataaatactggagcagctttaactagttacaaaatcattaacggcaaacatttctacttcaataacgacggcgttatgcagctgggtgttttcaaaggtccggatggttttgaatactttgccccggcaaacacccaaaacaacaacatcgaaggtcaggcaatcgtttatcagtccaaatttctgaccctgaacggtaaaaagtattacttcgacaacaattccaaagccgtaaccggttggcgcattattaacaacgagaagtactatttcaacccgaacaacgcgattgccgctgtgggcctgcaggttatcgacaacaacaaatattactttaacccggataccgcgatcatttccaaaggctggcagactgttaacggtagccgttactacttcgacacggataccgctattgcattcaacggttataaaaccattgatggcaaacacttctactttgattctgactgtgttgtgaaaatcggcgttttctctacctccaacggctttgaatacttcgctccggctaatacctacaacaataacatcgaaggtcaggccatcgtgtaccagtctaaattcctgaccctgaacggtaagaaatactatttcgacaacaactctaaagccgttaccggcctgcagaccatcgacagcaaaaagtactacttcaacactaacacggcggaagcagcgactggttggcagaccatcgacggcaaaaagtactattttaacactaatactgcggaggctgcgaccggctggcaaactatcgacggtaagaaatactactttaacaccaataccgctattgcttctaccggctacactatcatcaacggtaaacacttctatttcaacaccgatggtatcatgcagatcggtgtttttaaaggtcctaacggcttcgaatacttcgctccggcgaacaccgacgctaacaacattgaaggccaggctatcctgtaccagaatgaatttctgaccctgaacggcaagaaatattactttggttctgattctaaagccgtgaccggttggcgtatcatcaacaacaagaaatattacttcaacccgaacaacgcgattgcggctatccacctgtgcacgatcaacaacgacaaatactacttctcctatgatggcatcctgcagaacggttacatcaccattgagcgcaacaacttttacttcgacgcgaacaatgaatctaaaatggtaaccggtgtttttaaaggcccgaacggttttgagtactttgccccagcgaacacccataacaacaatattgagggccaggcgattgtatatcagaacaaatttctgactctgaacggcaagaaatactacttcgacaacgacagcaaagcggttactggctggcagaccattgatggcaaaaagtactatttcaacctgaacactgcagaagctgcgacgggctggcagactattgatggtaagaaatactacttcaacctgaacactgctgaagctgcgactggctggcagacgatcgacggcaagaaatattacttcaacaccaacaccttcatcgcgagcactggttatacgagcatcaacggtaaacacttctacttcaacaccgatggcattatgcagatcggtgtattcaaaggcccgaacggcttcgaatatttcgcaccggcgaacactgatgccaacaatatcgaaggtcaggcaatcctgtaccagaacaaatttctgaccctgaacggcaagaaatactattttggttctgactctaaggcagtaaccggtctgcgtacgatcgacggcaaaaagtactacttcaacactaacaccgcagtggccgttaccggttggcagaccatcaacggcaagaaatactactttaacaccaatactagcatcgcttctaccggttacaccatcatctccggcaagcacttctacttcaacaccgatggtattatgcagatcggtgtgttcaaaggtcctgatggtttcgaatacttcgctcctgccaacacggacgctaataacatcgagggccaggccattcgttaccaaaaccgcttcctgtatctgcatgacaacatctactactttggtaacaactccaaagcggcgaccggttgggttaccattgatggcaaccgttactattttgaaccgaacactgcgatgggcgcgaatggttataaaaccattgacaacaaaaacttctacttccgtaacggcctgccgcagattggcgtgttcaaaggttctaatggcttcgaatacttcgcaccggctaatacggacgcgaacaacattgaaggtcaggctatccgctaccagaaccgtttcctgcatctgctgggcaagatctactacttcggcaacaactctaaagctgttaccggctggcagacgattaatggtaaagtctactacttcatgccggataccgcaatggcagcagctggtggtctgttcgagattgatggcgtaatctatttcttcggcgtggacggtgttaaagctccgggtatttatggcctcgagcaccaccaccaccaccactga

SEQ ID NO: 2 - DNA, 8157 bp, Artificial Sequence
  VPI 10463 strain, W101 knock out TcdA (W101Del)
atgggatctttaatatctaaagaagagttaataaaactcgcatatagcattagaccaagagaaaatgagtataaaactatactaactaatttagacgaatataataagttaactacaaacaataatgaaaataaatatttgcaattaaaaaaactaaatgaatcaattgatgtttttatgaataaatataaaacttcaagcagaaatagagcactctctaatctaaaaaaagatatattaaaagaagtaattcttattaaaaattccaatacaagccctgtagaaaaaaatttacattttgtaataggtggagaagtcagtgatattgctcttgaatacataaaacaatgggctgatattaatgcagaatataatattaaactgtggtatgatagtgaagcattcttagtaaatacactaaaaaaggctatagttgaatcttctaccactgaagcattacagctactagaggaagagattcaaaatcctcaatttgataatatgaaattttacaaaaaaaggatggaatttatatatgatagacaaaaaaggtttataaattattataaatctcaaatcaataaacctacagtacctacaatagatgatattataaagtctcatctagtatctgaatataatagagatgaaactgtattagaatcatatagaacaaattctttgagaaaaataaatagtaatcatgggatagatatcagggctaatagtttgtttacagaacaagagttattaaatatttatagtcaggagttgttaaatcgtggaaatttagctgcagcatctgacatagtaagattattagccctaaaaaattttggcggagtatatttagatgttgatatgcttccaggtattcactctgatttatttaaaacaatatctagacctagctctattggactagaccgttgggaaatgataaaattagaggctattatgaagtataaaaaatatataaataattatacatcagaaaactttgataaacttgatcaacaattaaaagataattttaaactcattatagaaagtaaaagtgaaaaatctgagatattttctaaattagaaaatttaaatgtatctgatcttgaaattaaaatagctttcgctttaggcagtgttataaatcaagccttgatatcaaaacaaggttcatatcttactaacctagtaatagaacaagtaaaaaatagatatcaatttttaaaccaacaccttaacccagccatagagtctgataataacttcacagatactactaaaatttttcatgattcattatttaattcagctaccgcagaaaactctatgtttttaacaaaaatagcaccatacttacaagtaggttttatgccagaagctcgctccacaataagtttaagtggtccaggagcttatgcgtcagcttactatgatttcataaatttacaagaaaatactatagaaaaaactttaaaagcatcagatttaatagaatttaaattcccagaaaataatctatctcaattgacagaacaagaaataaatagtctatggagctttgatcaagcaagtgcaaaatatcaatttgagaaatatgtaagagattatactggtggatctctttctgaagacaatggggtagactttaataaaaatactgccctcgacaaaaactatttattaaataataaaattccatcaaacaatgtagaagaagctggaagtaaaaattatgttcattatatcatacagttacaaggagatgatataagttatgaagcaacatgcaatttattttctaaaaatcctaaaaatagtattattatacaacgaaatatgaatgaaagtgcaaaaagctactttttaagtgatgatggagaatctattttagaattaaataaatataggatacctgaaagattaaaaaataaggaaaaagtaaaagtaacctttattggacatggtaaagatgaattcaacacaagcgaatttgctagattaagtgtagattcactttccaatgagataagttcatttttagataccataaaattagatatatcacctaaaaatgtagaagtaaacttacttggatgtaatatgtttagttatgattttaatgttgaagaaacttatcctgggaagttgctattaagtattatggacaaaattacttccactttacctgatgtaaataaaaattctattactataggagcaaatcaatatgaagtaagaattaatagtgagggaagaaaagaacttctggctcactcaggtaaatggataaataaagaagaagctattatgagcgatttatctagtaaagaatacattttttttgattctatagataataagctaaaagcaaagtccaagaatattccaggattagcatcaatatcagaagatataaaaacattattacttgatgcaagtgttagtcctgatacaaaatttattttaaataatcttaagcttaatattgaatcttctattggggattacatttattatgaaaaattagagcctgttaaaaatataattcacaattctatagatgatttaatagatgagttcaatctacttgaaaatgtatctgatgaattatatgaattaaaaaaattaaataatctagatgagaagtatttaatatcttttgaagatatctcaaaaaataattcaacttactctgtaagatttattaacaaaagtaatggtgagtcagtttatgtagaaacagaaaaagaaattttttcaaaatatagcgaacatattacaaaagaaataagtactataaagaatagtataattacagatgttaatggtaatttattggataatatacagttagatcatacttctcaagttaatacattaaacgcagcattctttattcaatcattaatagattatagtagcaataaagatgtactgaatgatttaagtacctcagttaaggttcaactttatgctcaactatttagtacaggtttaaatactatatatgactctatccaattagtaaatttaatatcaaatgcagtaaatgatactataaatgtactacctacaataacagaggggatacctattgtatctactatattagacggaataaacttaggtgcagcaattaaggaattactagacgaacatgacccattactaaaaaaagaattagaagctaaggtgggtgttttagcaataaatatgtcattatctatagctgcaactgtagcttcaattgttggaataggtgctgaagttactattttcttattacctatagctggtatatctgcaggaataccttcattagttaataatgaattaatattgcatgataaggcaacttcagtggtaaactattttaatcatttgtctgaatctaaaaaatatggccctcttaaaacagaagatgataaaattttagttcctattgatgatttagtaatatcagaaatagattttaataataattcgataaaactaggaacatgtaatatattagcaatggaggggggatcaggacacacagtgactggtaatatagatcactttttctcatctccatctataagttctcatattccttcattatcaatttattctgcaataggtatagaaacagaaaatctagatttttcaaaaaaaataatgatgttacctaatgctccttcaagagtgttttggtgggaaactggagcagttccaggtttaagatcattggaaaatgacggaactagattacttgattcaataagagatttatacccaggtaaattttactggagattctatgcttttttcgattatgcaataactacattaaaaccagtttatgaagacactaatattaaaattaaactagataaagatactagaaacttcataatgccaactataactactaacgaaattagaaacaaattatcttattcatttgatggagcaggaggaacttactctttattattatcttcatatccaatatcaacgaatataaatttatctaaagatgatttatggatatttaatattgataatgaagtaagagaaatatctatagaaaatggtactattaaaaaaggaaagttaataaaagatgttttaagtaaaattgatataaataaaaataaacttattataggcaatcaaacaatagatttttcaggcgatatagataataaagatagatatatattcttgacttgtgagttagatgataaaattagtttaataatagaaataaatcttgttgcaaaatcttatagtttgttattgtctggggataaaaattatttgatatccaatttatctaatactattgagaaaatcaatactttaggcctagatagtaaaaatatagcgtacaattacactgatgaatctaataataaatattttggagctatatctaaaacaagtcaaaaaagcataatacattataaaaaagacagtaaaaatatattagaattttataatgacagtacattagaatttaacagtaaagattttattgctgaagatataaatgtatttatgaaagatgatattaatactataacaggaaaatactatgttgataataatactgataaaagtatagatttctctatttctttagttagtaaaaatcaagtaaaagtaaatggattatatttaaatgaatccgtatactcatcttaccttgattttgtgaaaaattcagatggacaccataatacttctaattttatgaatttatttttggacaatataagtttctggaaattgtttgggtttgaaaatataaattttgtaatcgataaatactttacccttgttggtaaaactaatcttggatatgtagaatttatttgtgacaataataaaaatatagatatatattttggtgaatggaaaacatcgtcatctaaaagcactatatttagcggaaatggtagaaatgttgtagtagagcctatatataatcctgatacgggtgaagatatatctacttcactagatttttcctatgaacctctctatggaatagatagatatataaataaagtattgatagcacctgatttatatacaagtttaataaatattaataccaattattattcaaatgagtactaccctgagattatagttcttaacccaaatacattccacaaaaaagtaaatataaatttagatagttcttcttttgagtataaatggtctacagaaggaagtgactttattttagttagatacttagaagaaagtaataaaaaaatattacaaaaaataagaatcaaaggtatcttatctaatactcaatcatttaataaaatgagtatagattttaaagatattaaaaaactatcattaggatatataatgagtaattttaaatcatttaattctgaaaatgaattagatagagatcatttaggatttaaaataatagataataaaacttattactatgatgaagatagtaaattagttaaaggattaatcaatataaataattcattattctattttgatcctatagaatttaacttagtaactggatggcaaactatcaatggtaaaaaatattattttgatataaatactggagcagctttaactagttacaaaatcattaacggcaaacatttctacttcaataacgacggcgttatgcagctgggtgttttcaaaggtccggatggttttgaatactttgccccggcaaacacccaaaacaacaacatcgaaggtcaggcaatcgtttatcagtccaaatttctgaccctgaacggtaaaaagtattacttcgacaacaattccaaagccgtaaccggttggcgcattattaacaacgagaagtactatttcaacccgaacaacgcgattgccgctgtgggcctgcaggttatcgacaacaacaaatattactttaacccggataccgcgatcatttccaaaggctggcagactgttaacggtagccgttactacttcgacacggataccgctattgcattcaacggttataaaaccattgatggcaaacacttctactttgattctgactgtgttgtgaaaatcggcgttttctctacctccaacggctttgaatacttcgctccggctaatacctacaacaataacatcgaaggtcaggccatcgtgtaccagtctaaattcctgaccctgaacggtaagaaatactatttcgacaacaactctaaagccgttaccggcctgcagaccatcgacagcaaaaagtactacttcaacactaacacggcggaagcagcgactggttggcagaccatcgacggcaaaaagtactattttaacactaatactgcggaggctgcgaccggctggcaaactatcgacggtaagaaatactactttaacaccaataccgctattgcttctaccggctacactatcatcaacggtaaacacttctatttcaacaccgatggtatcatgcagatcggtgtttttaaaggtcctaacggcttcgaatacttcgctccggcgaacaccgacgctaacaacattgaaggccaggctatcctgtaccagaatgaatttctgaccctgaacggcaagaaatattactttggttctgattctaaagccgtgaccggttggcgtatcatcaacaacaagaaatattacttcaacccgaacaacgcgattgcggctatccacctgtgcacgatcaacaacgacaaatactacttctcctatgatggcatcctgcagaacggttacatcaccattgagcgcaacaacttttacttcgacgcgaacaatgaatctaaaatggtaaccggtgtttttaaaggcccgaacggttttgagtactttgccccagcgaacacccataacaacaatattgagggccaggcgattgtatatcagaacaaatttctgactctgaacggcaagaaatactacttcgacaacgacagcaaagcggttactggctggcagaccattgatggcaaaaagtactatttcaacctgaacactgcagaagctgcgacgggctggcagactattgatggtaagaaatactacttcaacctgaacactgctgaagctgcgactggctggcagacgatcgacggcaagaaatattacttcaacaccaacaccttcatcgcgagcactggttatacgagcatcaacggtaaacacttctacttcaacaccgatggcattatgcagatcggtgtattcaaaggcccgaacggcttcgaatatttcgcaccggcgaacactgatgccaacaatatcgaaggtcaggcaatcctgtaccagaacaaatttctgaccctgaacggcaagaaatactattttggttctgactctaaggcagtaaccggtctgcgtacgatcgacggcaaaaagtactacttcaacactaacaccgcagtggccgttaccggttggcagaccatcaacggcaagaaatactactttaacaccaatactagcatcgcttctaccggttacaccatcatctccggcaagcacttctacttcaacaccgatggtattatgcagatcggtgtgttcaaaggtcctgatggtttcgaatacttcgctcctgccaacacggacgctaataacatcgagggccaggccattcgttaccaaaaccgcttcctgtatctgcatgacaacatctactactttggtaacaactccaaagcggcgaccggttgggttaccattgatggcaaccgttactattttgaaccgaacactgcgatgggcgcgaatggttataaaaccattgacaacaaaaacttctacttccgtaacggcctgccgcagattggcgtgttcaaaggttctaatggcttcgaatacttcgcaccggctaatacggacgcgaacaacattgaaggtcaggctatccgctaccagaaccgtttcctgcatctgctgggcaagatctactacttcggcaacaactctaaagctgttaccggctggcagacgattaatggtaaagtctactacttcatgccggataccgcaatggcagcagctggtggtctgttcgagattgatggcgtaatctatttcttcggcgtggacggtgttaaagctccgggtatttatggcctcgagcaccaccaccaccaccactga

SEQ ID NO: 3 - DNA, 8157 bp, Artificial Sequence
  VPI 10463 strain, E. coli optimized W101A, D287A, E514Q TcdA (tri)
atgtcgctgattagcaaggaagagctgattaagttggcgtatagcattcgcccgcgcgagaacgaatataagacgatcctgaccaacttggatgagtataataaattgactacgaacaataacgagaacaagtatttgcagctgaagaaactgaatgagtccatcgacgtctttatgaataagtacaaaacgtcttcgcgcaaccgcgccttgtctaacctgaagaaggacattttgaaggaggtcattctgattaagaatagcaatacgagcccggttgaaaagaacctgcattttgtcgccattggcggtgaagttagcgacattgcgctggaatatatcaagcaatgggcagacattaacgcggagtataacatcaagttgtggtacgactctgaggcatttttggttaacactttgaaaaaggccatcgtggagagcagcacgactgaagcgttgcaattgctggaggaagagatccagaatccgcagtttgacaatatgaaattctacaagaaacgcatggagttcatttatgaccgtcaaaaacgcttcattaactactataaatcccaaatcaacaaaccgaccgttccaacgatcgatgacattatcaaatcccacctggtgtcggagtacaatcgcgacgaaaccgttctggagtcctaccgcaccaacagcctgcgcaaaatcaatagcaatcatggcattgatattcgtgctaactcgttgttcactgaacaggaactgttgaatatttacagccaggagttgttgaaccgtggtaacctggcggcggcgtcggacatcgttcgcttgctggcgctgaagaacttcggtggtgtttatctggatgttgccatgctgccgggcattcactctgacttgtttaaaaccattagccgtccatccagcatcggcctggatcgttgggagatgattaaactggaagccatcatgaagtataagaaatacatcaacaactacacctcggaaaacttcgataaattggatcaacaattgaaagataactttaagctgattatcgagagcaagtctgaaaagagcgaaattttcagcaaactggagaacctgaatgtgagcgacctggagattaagattgcgttcgcgctgggttcggttatcaaccaggcactgatcagcaaacaaggctcctatttgacgaacttggtgatcgagcaggtcaaaaaccgctaccaattcctgaaccaacatctgaatccggccatcgaatccgataataactttacggacaccaccaagattttccatgactctctgtttaactccgcgaccgccgaaaattctatgtttctgaccaaaatcgccccttatttgcaagtcggcttcatgccggaggctcgcagcacgatcagcttgtctggtccgggcgcttatgcgtccgcgtattacgatttcatcaacttgcaggaaaacaccatcgagaaaaccctgaaggccagcgacctgattgagtttaagtttccagagaacaatctgagccaactgaccgaacagcaaatcaattccctgtggagctttgaccaagcgagcgcaaaatatcaattcgaaaagtacgtgcgtgactataccggtggtagcctgagcgaagacaacggcgttgattttaacaagaatacggcgctggataaaaactatctgctgaataataagatcccgtcgaacaacgttgaagaggctggcagcaaaaactacgtgcattacattatccaactgcaaggtgacgacatcagctatgaggccacgtgcaacctgtttagcaagaatccgaaaaactcgatcatcattcaacgcaacatgaacgagtcggcgaagagctatttcctgtctgatgacggcgagtcgattctggagctgaacaagtaccgcattccggagcgtctgaagaacaaggagaaggtcaaagttaccttcattggtcacggcaaggacgagttcaatacctccgagtttgcacgcctgtccgttgacagcttgagcaatgagattagcagctttctggacacgatcaagttggacatctctccgaaaaatgtggaggtgaacctgctgggctgcaatatgttttcctacgattttaacgttgaggaaacttatccgggtaagttgctgctgagcattatggataagattacgagcaccttgccagacgttaacaaaaactccattaccattggcgcaaatcaatatgaggtgcgtattaattcggagggtcgcaaagagctgctggcccatagcggcaaatggattaataaggaagaggctattatgtctgatctgtcttccaaggagtacatcttctttgattccattgacaataagctgaaagcgaagtcgaaaaacatcccgggtttggcatcgattagcgaggatatcaagaccttgctgttggatgcgtcggtttcgccggataccaagtttatcctgaacaatttgaagcttaacattgagagctcgatcggcgactacatttactatgagaaactggaaccggtgaagaatatcatccacaactctatcgatgacttgatcgatgaattcaacttgctggagaacgtgtccgatgagctgtatgagctgaaaaagttgaacaacctggacgagaagtatttgattagctttgaggacatttcgaaaaataactccacctatagcgtccgctttatcaacaaaagcaacggtgaatctgtgtacgtggagactgagaaggagattttcagcaagtatagcgagcatattaccaaggaaatttctaccattaaaaactccattatcacggatgtcaacggcaacctgttggataatatccagttggaccatactagccaggtgaataccctgaatgcggccttcttcatccaaagcctgattgattatagctccaacaaggacgtgttgaatgatctgagcacgtccgttaaggtgcaattgtacgcgcagttgttcagcacgggtctgaatacgatttacgatagcattcaattggttaatttgatctcgaacgcagtgaacgatacgattaacgtgctgccgaccattaccgaaggtattccgattgtcagcaccattctggacggcatcaatctgggcgcggcgatcaaggagctgctggacgagcatgatccactgctgaaaaaggaattggaggcgaaagttggcgtcctggcgattaacatgtcgctgtccattgccgcaactgtcgcctcgattgtcggcattggcgcggaggtgacgatctttctgctgccaattgcgggtatctctgcaggcattccgtccttggttaacaacgagctgattctgcacgacaaggccacctctgtggttaactactttaatcatctgagcgagtcgaagaaatatggtcctctgaagaccgaagatgataagattctggtgccgatcgacgatttggtgatcagcgagattgactttaacaacaactcgatcaagctgggtacctgtaatatcctggctatggagggtggctcgggtcacaccgtcacgggtaatatcgaccacttcttcagcagcccgagcattagctcgcacattccgtctctgtcgatttactcggccatcggtatcgaaaccgagaacctggactttagcaagaagatcatgatgctgccaaatgcaccttctcgtgtcttttggtgggaaacgggcgctgttccaggcctgcgttctctggaaaacgatggtacccgcttgctggactcgatccgcgatttgtacccgggcaaattctactggcgtttctatgcgttctttgactacgcgattaccaccctgaagccagtttacgaggataccaacatcaaaattaagctggataaagatactcgtaactttattatgccgacgatcaccacgaacgagattcgcaacaaactgtcctattctttcgacggtgcgggcggtacctatagcttgctgctgagctcttacccgatctccacgaatattaacctgagcaaggacgatttgtggatcttcaacattgataacgaggtgcgtgagatctctatcgagaatggtacgattaagaagggtaagctgatcaaagacgttctgagcaaaattgacattaacaagaataagctgattattggcaaccagaccattgatttttcgggcgacatcgataacaaggaccgctacattttcctgacttgcgaactggatgacaagatcagcttgattatcgaaattaatctggtcgccaaaagctactccttgttgctgtccggcgacaaaaactatctgatctctaacctgtcgaatacgatcgaaaagattaacactctgggtctggacagcaagaacatcgcgtataactataccgacgagtctaacaacaagtatttcggtgcaatctcgaagacgagccagaagtcgatcatccactacaaaaaggactctaagaacattctggagttctataacgactctaccttggaattcaattcgaaggattttatcgccgaagacatcaacgtgttcatgaaggatgatatcaatacgatcaccggtaagtactatgtcgataataacaccgataaatccattgacttcagcatctcgctggtttctaaaaaccaagtgaaggttaacggtctgtatctgaatgagagcgtttattcctcctatttggactttgtgaaaaacagcgacggtcatcataacacctccaactttatgaacctgtttctggacaacatttccttctggaaactgtttggcttcgagaatattaactttgtgattgacaaatactttactctggttggtaaaaccaacctgggttacgtggagtttatctgcgacaacaataagaatatcgacatctacttcggtgaatggaaaaccagcagctccaagagcaccatcttctctggtaacggccgtaacgtggtcgtggagccgatttacaatccggacactggcgaagatatttccacttctctggatttcagctatgaaccgctgtatggcattgatcgctacatcaataaagtgctgattgcgccagatctgtacacgagcctgatcaatattaacacgaattactactccaacgagtattacccggagattattgtgttgaacccgaatacctttcacaagaaagtgaacattaacttggatagctccagctttgaatacaaatggtcgacggagggctccgatttcattctggtccgttacctggaggagtccaacaagaagattttgcagaaaatccgtattaaaggcatcctgagcaatacccagagcttcaacaagatgtccatcgactttaaagacattaagaagctgtcgttgggctatatcatgtcgaattttaagagctttaactccgaaaacgaactggaccgtgatcatctgggctttaagatcattgataataagacctattactacgacgaagacagcaagctggtcaaaggcctgattaatatcaacaacagcttgttctactttgatccaattgagtttaacctggtcacgggttggcaaaccattaacggtaaaaagtattactttgacatcaatacgggcgcagctctgactagttacaaaatcattaacggcaaacatttctacttcaataacgacggcgttatgcagctgggtgttttcaaaggtccggatggttttgaatactttgccccggcaaacacccaaaacaacaacatcgaaggtcaggcaatcgtttatcagtccaaatttctgaccctgaacggtaaaaagtattacttcgacaacaattccaaagccgtaaccggttggcgcattattaacaacgagaagtactatttcaacccgaacaacgcgattgccgctgtgggcctgcaggttatcgacaacaacaaatattactttaacccggataccgcgatcatttccaaaggctggcagactgttaacggtagccgttactacttcgacacggataccgctattgcattcaacggttataaaaccattgatggcaaacacttctactttgattctgactgtgttgtgaaaatcggcgttttctctacctccaacggctttgaatacttcgctccggctaatacctacaacaataacatcgaaggtcaggccatcgtgtaccagtctaaattcctgaccctgaacggtaagaaatactatttcgacaacaactctaaagccgttaccggcctgcagaccatcgacagcaaaaagtactacttcaacactaacacggcggaagcagcgactggttggcagaccatcgacggcaaaaagtactattttaacactaatactgcggaggctgcgaccggctggcaaactatcgacggtaagaaatactactttaacaccaataccgctattgcttctaccggctacactatcatcaacggtaaacacttctatttcaacaccgatggtatcatgcagatcggtgtttttaaaggtcctaacggcttcgaatacttcgctccggcgaacaccgacgctaacaacattgaaggccaggctatcctgtaccagaatgaatttctgaccctgaacggcaagaaatattactttggttctgattctaaagccgtgaccggttggcgtatcatcaacaacaagaaatattacttcaacccgaacaacgcgattgcggctatccacctgtgcacgatcaacaacgacaaatactacttctcctatgatggcatcctgcagaacggttacatcaccattgagcgcaacaacttttacttcgacgcgaacaatgaatctaaaatggtaaccggtgtttttaaaggcccgaacggttttgagtactttgccccagcgaacacccataacaacaatattgagggccaggcgattgtatatcagaacaaatttctgactctgaacggcaagaaatactacttcgacaacgacagcaaagcggttactggctggcagaccattgatggcaaaaagtactatttcaacctgaacactgcagaagctgcgacgggctggcagactattgatggtaagaaatactacttcaacctgaacactgctgaagctgcgactggctggcagacgatcgacggcaagaaatattacttcaacaccaacaccttcatcgcgagcactggttatacgagcatcaacggtaaacacttctacttcaacaccgatggcattatgcagatcggtgtattcaaaggcccgaacggcttcgaatatttcgcaccggcgaacactgatgccaacaatatcgaaggtcaggcaatcctgtaccagaacaaatttctgaccctgaacggcaagaaatactattttggttctgactctaaggcagtaaccggtctgcgtacgatcgacggcaaaaagtactacttcaacactaacaccgcagtggccgttaccggttggcagaccatcaacggcaagaaatactactttaacaccaatactagcatcgcttctaccggttacaccatcatctccggcaagcacttctacttcaacaccgatggtattatgcagatcggtgtgttcaaaggtcctgatggtttcgaatacttcgctcctgccaacacggacgctaataacatcgagggccaggccattcgttaccaaaaccgcttcctgtatctgcatgacaacatctactactttggtaacaactccaaagcggcgaccggttgggttaccattgatggcaaccgttactattttgaaccgaacactgcgatgggcgcgaatggttataaaaccattgacaacaaaaacttctacttccgtaacggcctgccgcagattggcgtgttcaaaggttctaatggcttcgaatacttcgcaccggctaatacggacgcgaacaacattgaaggtcaggctatccgctaccagaaccgtttcctgcatctgctgggcaagatctactacttcggcaacaactctaaagctgttaccggctggcagacgattaatggtaaagtctactacttcatgccggataccgcaatggcagcagctggtggtctgttcgagattgatggcgtaatctatttcttcggcgtggacggtgttaaagctccgggtatttatggcctcgagcaccaccaccaccaccactga

SEQ ID NO: 4 - DNA, 8157 bp, Artificial Sequence
  VPI 10463 strain, E. coli optimized W101A, D285A, D287A, E514Q TcdA (Quad D285)
atgtcgctgattagcaaggaagagctgattaagttggcgtatagcattcgcccgcgcgagaacgaatataagacgatcctgaccaacttggatgagtataataaattgactacgaacaataacgagaacaagtatttgcagctgaagaaactgaatgagtccatcgacgtctttatgaataagtacaaaacgtcttcgcgcaaccgcgccttgtctaacctgaagaaggacattttgaaggaggtcattctgattaagaatagcaatacgagcccggttgaaaagaacctgcattttgtcgccattggcggtgaagttagcgacattgcgctggaatatatcaagcaatgggcagacattaacgcggagtataacatcaagttgtggtacgactctgaggcatttttggttaacactttgaaaaaggccatcgtggagagcagcacgactgaagcgttgcaattgctggaggaagagatccagaatccgcagtttgacaatatgaaattctacaagaaacgcatggagttcatttatgaccgtcaaaaacgcttcattaactactataaatcccaaatcaacaaaccgaccgttccaacgatcgatgacattatcaaatcccacctggtgtcggagtacaatcgcgacgaaaccgttctggagtcctaccgcaccaacagcctgcgcaaaatcaatagcaatcatggcattgatattcgtgctaactcgttgttcactgaacaggaactgttgaatatttacagccaggagttgttgaaccgtggtaacctggcggcggcgtcggacatcgttcgcttgctggcgctgaagaacttcggtggtgtttatctggctgttgccatgctgccgggcattcactctgacttgtttaaaaccattagccgtccatccagcatcggcctggatcgttgggagatgattaaactggaagccatcatgaagtataagaaatacatcaacaactacacctcggaaaacttcgataaattggatcaacaattgaaagataactttaagctgattatcgagagcaagtctgaaaagagcgaaattttcagcaaactggagaacctgaatgtgagcgacctggagattaagattgcgttcgcgctgggttcggttatcaaccaggcactgatcagcaaacaaggctcctatttgacgaacttggtgatcgagcaggtcaaaaaccgctaccaattcctgaaccaacatctgaatccggccatcgaatccgataataactttacggacaccaccaagattttccatgactctctgtttaactccgcgaccgccgaaaattctatgtttctgaccaaaatcgccccttatttgcaagtcggcttcatgccggaggctcgcagcacgatcagcttgtctggtccgggcgcttatgcgtccgcgtattacgatttcatcaacttgcaggaaaacaccatcgagaaaaccctgaaggccagcgacctgattgagtttaagtttccagagaacaatctgagccaactgaccgaacagcaaatcaattccctgtggagctttgaccaagcgagcgcaaaatatcaattcgaaaagtacgtgcgtgactataccggtggtagcctgagcgaagacaacggcgttgattttaacaagaatacggcgctggataaaaactatctgctgaataataagatcccgtcgaacaacgttgaagaggctggcagcaaaaactacgtgcattacattatccaactgcaaggtgacgacatcagctatgaggccacgtgcaacctgtttagcaagaatccgaaaaactcgatcatcattcaacgcaacatgaacgagtcggcgaagagctatttcctgtctgatgacggcgagtcgattctggagctgaacaagtaccgcattccggagcgtctgaagaacaaggagaaggtcaaagttaccttcattggtcacggcaaggacgagttcaatacctccgagtttgcacgcctgtccgttgacagcttgagcaatgagattagcagctttctggacacgatcaagttggacatctctccgaaaaatgtggaggtgaacctgctgggctgcaatatgttttcctacgattttaacgttgaggaaacttatccgggtaagttgctgctgagcattatggataagattacgagcaccttgccagacgttaacaaaaactccattaccattggcgcaaatcaatatgaggtgcgtattaattcggagggtcgcaaagagctgctggcccatagcggcaaatggattaataaggaagaggctattatgtctgatctgtcttccaaggagtacatcttctttgattccattgacaataagctgaaagcgaagtcgaaaaacatcccgggtttggcatcgattagcgaggatatcaagaccttgctgttggatgcgtcggtttcgccggataccaagtttatcctgaacaatttgaagcttaacattgagagctcgatcggcgactacatttactatgagaaactggaaccggtgaagaatatcatccacaactctatcgatgacttgatcgatgaattcaacttgctggagaacgtgtccgatgagctgtatgagctgaaaaagttgaacaacctggacgagaagtatttgattagctttgaggacatttcgaaaaataactccacctatagcgtccgctttatcaacaaaagcaacggtgaatctgtgtacgtggagactgagaaggagattttcagcaagtatagcgagcatattaccaaggaaatttctaccattaaaaactccattatcacggatgtcaacggcaacctgttggataatatccagttggaccatactagccaggtgaataccctgaatgcggccttcttcatccaaagcctgattgattatagctccaacaaggacgtgttgaatgatctgagcacgtccgttaaggtgcaattgtacgcgcagttgttcagcacgggtctgaatacgatttacgatagcattcaattggttaatttgatctcgaacgcagtgaacgatacgattaacgtgctgccgaccattaccgaaggtattccgattgtcagcaccattctggacggcatcaatctgggcgcggcgatcaaggagctgctggacgagcatgatccactgctgaaaaaggaattggaggcgaaagttggcgtcctggcgattaacatgtcgctgtccattgccgcaactgtcgcctcgattgtcggcattggcgcggaggtgacgatctttctgctgccaattgcgggtatctctgcaggcattccgtccttggttaacaacgagctgattctgcacgacaaggccacctctgtggttaactactttaatcatctgagcgagtcgaagaaatatggtcctctgaagaccgaagatgataagattctggtgccgatcgacgatttggtgatcagcgagattgactttaacaacaactcgatcaagctgggtacctgtaatatcctggctatggagggtggctcgggtcacaccgtcacgggtaatatcgaccacttcttcagcagcccgagcattagctcgcacattccgtctctgtcgatttactcggccatcggtatcgaaaccgagaacctggactttagcaagaagatcatgatgctgccaaatgcaccttctcgtgtcttttggtgggaaacgggcgctgttccaggcctgcgttctctggaaaacgatggtacccgcttgctggactcgatccgcgatttgtacccgggcaaattctactggcgtttctatgcgttctttgactacgcgattaccaccctgaagccagtttacgaggataccaacatcaaaattaagctggataaagatactcgtaactttattatgccgacgatcaccacgaacgagattcgcaacaaactgtcctattctttcgacggtgcgggcggtacctatagcttgctgctgagctcttacccgatctccacgaatattaacctgagcaaggacgatttgtggatcttcaacattgataacgaggtgcgtgagatctctatcgagaatggtacgattaagaagggtaagctgatcaaagacgttctgagcaaaattgacattaacaagaataagctgattattggcaaccagaccattgatttttcgggcgacatcgataacaaggaccgctacattttcctgacttgcgaactggatgacaagatcagcttgattatcgaaattaatctggtcgccaaaagctactccttgttgctgtccggcgacaaaaactatctgatctctaacctgtcgaatacgatcgaaaagattaacactctgggtctggacagcaagaacatcgcgtataactataccgacgagtctaacaacaagtatttcggtgcaatctcgaagacgagccagaagtcgatcatccactacaaaaaggactctaagaacattctggagttctataacgactctaccttggaattcaattcgaaggattttatcgccgaagacatcaacgtgttcatgaaggatgatatcaatacgatcaccggtaagtactatgtcgataataacaccgataaatccattgacttcagcatctcgctggtttctaaaaaccaagtgaaggttaacggtctgtatctgaatgagagcgtttattcctcctatttggactttgtgaaaaacagcgacggtcatcataacacctccaactttatgaacctgtttctggacaacatttccttctggaaactgtttggcttcgagaatattaactttgtgattgacaaatactttactctggttggtaaaaccaacctgggttacgtggagtttatctgcgacaacaataagaatatcgacatctacttcggtgaatggaaaaccagcagctccaagagcaccatcttctctggtaacggccgtaacgtggtcgtggagccgatttacaatccggacactggcgaagatatttccacttctctggatttcagctatgaaccgctgtatggcattgatcgctacatcaataaagtgctgattgcgccagatctgtacacgagcctgatcaatattaacacgaattactactccaacgagtattacccggagattattgtgttgaacccgaatacctttcacaagaaagtgaacattaacttggatagctccagctttgaatacaaatggtcgacggagggctccgatttcattctggtccgttacctggaggagtccaacaagaagattttgcagaaaatccgtattaaaggcatcctgagcaatacccagagcttcaacaagatgtccatcgactttaaagacattaagaagctgtcgttgggctatatcatgtcgaattttaagagctttaactccgaaaacgaactggaccgtgatcatctgggctttaagatcattgataataagacctattactacgacgaagacagcaagctggtcaaaggcctgattaatatcaacaacagcttgttctactttgatccaattgagtttaacctggtcacgggttggcaaaccattaacggtaaaaagtattactttgacatcaatacgggcgcagctctgactagttacaaaatcattaacggcaaacatttctacttcaataacgacggcgttatgcagctgggtgttttcaaaggtccggatggttttgaatactttgccccggcaaacacccaaaacaacaacatcgaaggtcaggcaatcgtttatcagtccaaatttctgaccctgaacggtaaaaagtattacttcgacaacaattccaaagccgtaaccggttggcgcattattaacaacgagaagtactatttcaacccgaacaacgcgattgccgctgtgggcctgcaggttatcgacaacaacaaatattactttaacccggataccgcgatcatttccaaaggctggcagactgttaacggtagccgttactacttcgacacggataccgctattgcattcaacggttataaaaccattgatggcaaacacttctactttgattctgactgtgttgtgaaaatcggcgttttctctacctccaacggctttgaatacttcgctccggctaatacctacaacaataacatcgaaggtcaggccatcgtgtaccagtctaaattcctgaccctgaacggtaagaaatactatttcgacaacaactctaaagccgttaccggcctgcagaccatcgacagcaaaaagtactacttcaacactaacacggcggaagcagcgactggttggcagaccatcgacggcaaaaagtactattttaacactaatactgcggaggctgcgaccggctggcaaactatcgacggtaagaaatactactttaacaccaataccgctattgcttctaccggctacactatcatcaacggtaaacacttctatttcaacaccgatggtatcatgcagatcggtgtttttaaaggtcctaacggcttcgaatacttcgctccggcgaacaccgacgctaacaacattgaaggccaggctatcctgtaccagaatgaatttctgaccctgaacggcaagaaatattactttggttctgattctaaagccgtgaccggttggcgtatcatcaacaacaagaaatattacttcaacccgaacaacgcgattgcggctatccacctgtgcacgatcaacaacgacaaatactacttctcctatgatggcatcctgcagaacggttacatcaccattgagcgcaacaacttttacttcgacgcgaacaatgaatctaaaatggtaaccggtgtttttaaaggcccgaacggttttgagtactttgccccagcgaacacccataacaacaatattgagggccaggcgattgtatatcagaacaaatttctgactctgaacggcaagaaatactacttcgacaacgacagcaaagcggttactggctggcagaccattgatggcaaaaagtactatttcaacctgaacactgcagaagctgcgacgggctggcagactattgatggtaagaaatactacttcaacctgaacactgctgaagctgcgactggctggcagacgatcgacggcaagaaatattacttcaacaccaacaccttcatcgcgagcactggttatacgagcatcaacggtaaacacttctacttcaacaccgatggcattatgcagatcggtgtattcaaaggcccgaacggcttcgaatatttcgcaccggcgaacactgatgccaacaatatcgaaggtcaggcaatcctgtaccagaacaaatttctgaccctgaacggcaagaaatactattttggttctgactctaaggcagtaaccggtctgcgtacgatcgacggcaaaaagtactacttcaacactaacaccgcagtggccgttaccggttggcagaccatcaacggcaagaaatactactttaacaccaatactagcatcgcttctaccggttacaccatcatctccggcaagcacttctacttcaacaccgatggtattatgcagatcggtgtgttcaaaggtcctgatggtttcgaatacttcgctcctgccaacacggacgctaataacatcgagggccaggccattcgttaccaaaaccgcttcctgtatctgcatgacaacatctactactttggtaacaactccaaagcggcgaccggttgggttaccattgatggcaaccgttactattttgaaccgaacactgcgatgggcgcgaatggttataaaaccattgacaacaaaaacttctacttccgtaacggcctgccgcagattggcgtgttcaaaggttctaatggcttcgaatacttcgcaccggctaatacggacgcgaacaacattgaaggtcaggctatccgctaccagaaccgtttcctgcatctgctgggcaagatctactacttcggcaacaactctaaagctgttaccggctggcagacgattaatggtaaagtctactacttcatgccggataccgcaatggcagcagctggtggtctgttcgagattgatggcgtaatctatttcttcggcgtggacggtgttaaagctccgggtatttatggcctcgagcaccaccaccaccaccactga

SEQ ID NO: 5 - DNA, 8157 bp, Artificial Sequence
  VPI 10463 strain, E. coli optimized W101A, D287A, E514Q, S517A TcdA (Quad S517)
atgtcgctgattagcaaggaagagctgattaagttggcgtatagcattcgcccgcgcgagaacgaatataagacgatcctgaccaacttggatgagtataataaattgactacgaacaataacgagaacaagtatttgcagctgaagaaactgaatgagtccatcgacgtctttatgaataagtacaaaacgtcttcgcgcaaccgcgccttgtctaacctgaagaaggacattttgaaggaggtcattctgattaagaatagcaatacgagcccggttgaaaagaacctgcattttgtcgccattggcggtgaagttagcgacattgcgctggaatatatcaagcaatgggcagacattaacgcggagtataacatcaagttgtggtacgactctgaggcatttttggttaacactttgaaaaaggccatcgtggagagcagcacgactgaagcgttgcaattgctggaggaagagatccagaatccgcagtttgacaatatgaaattctacaagaaacgcatggagttcatttatgaccgtcaaaaacgcttcattaactactataaatcccaaatcaacaaaccgaccgttccaacgatcgatgacattatcaaatcccacctggtgtcggagtacaatcgcgacgaaaccgttctggagtcctaccgcaccaacagcctgcgcaaaatcaatagcaatcatggcattgatattcgtgctaactcgttgttcactgaacaggaactgttgaatatttacagccaggagttgttgaaccgtggtaacctggcggcggcgtcggacatcgttcgcttgctggcgctgaagaacttcggtggtgtttatctggatgttgccatgctgccgggcattcactctgacttgtttaaaaccattagccgtccatccagcatcggcctggatcgttgggagatgattaaactggaagccatcatgaagtataagaaatacatcaacaactacacctcggaaaacttcgataaattggatcaacaattgaaagataactttaagctgattatcgagagcaagtctgaaaagagcgaaattttcagcaaactggagaacctgaatgtgagcgacctggagattaagattgcgttcgcgctgggttcggttatcaaccaggcactgatcagcaaacaaggctcctatttgacgaacttggtgatcgagcaggtcaaaaaccgctaccaattcctgaaccaacatctgaatccggccatcgaatccgataataactttacggacaccaccaagattttccatgactctctgtttaactccgcgaccgccgaaaattctatgtttctgaccaaaatcgccccttatttgcaagtcggcttcatgccggaggctcgcagcacgatcagcttgtctggtccgggcgcttatgcgtccgcgtattacgatttcatcaacttgcaggaaaacaccatcgagaaaaccctgaaggccagcgacctgattgagtttaagtttccagagaacaatctgagccaactgaccgaacagcaaatcaatgccctgtggagctttgaccaagcgagcgcaaaatatcaattcgaaaagtacgtgcgtgactataccggtggtagcctgagcgaagacaacggcgttgattttaacaagaatacggcgctggataaaaactatctgctgaataataagatcccgtcgaacaacgttgaagaggctggcagcaaaaactacgtgcattacattatccaactgcaaggtgacgacatcagctatgaggccacgtgcaacctgtttagcaagaatccgaaaaactcgatcatcattcaacgcaacatgaacgagtcggcgaagagctatttcctgtctgatgacggcgagtcgattctggagctgaacaagtaccgcattccggagcgtctgaagaacaaggagaaggtcaaagttaccttcattggtcacggcaaggacgagttcaatacctccgagtttgcacgcctgtccgttgacagcttgagcaatgagattagcagctttctggacacgatcaagttggacatctctccgaaaaatgtggaggtgaacctgctgggctgcaatatgttttcctacgattttaacgttgaggaaacttatccgggtaagttgctgctgagcattatggataagattacgagcaccttgccagacgttaacaaaaactccattaccattggcgcaaatcaatatgaggtgcgtattaattcggagggtcgcaaagagctgctggcccatagcggcaaatggattaataaggaagaggctattatgtctgatctgtcttccaaggagtacatcttctttgattccattgacaataagctgaaagcgaagtcgaaaaacatcccgggtttggcatcgattagcgaggatatcaagaccttgctgttggatgcgtcggtttcgccggataccaagtttatcctgaacaatttgaagcttaacattgagagctcgatcggcgactacatttactatgagaaactggaaccggtgaagaatatcatccacaactctatcgatgacttgatcgatgaattcaacttgctggagaacgtgtccgatgagctgtatgagctgaaaaagttgaacaacctggacgagaagtatttgattagctttgaggacatttcgaaaaataactccacctatagcgtccgctttatcaacaaaagcaacggtgaatctgtgtacgtggagactgagaaggagattttcagcaagtatagcgagcatattaccaaggaaatttctaccattaaaaactccattatcacggatgtcaacggcaacctgttggataatatccagttggaccatactagccaggtgaataccctgaatgcggccttcttcatccaaagcctgattgattatagctccaacaaggacgtgttgaatgatctgagcacgtccgttaaggtgcaattgtacgcgcagttgttcagcacgggtctgaatacgatttacgatagcattcaattggttaatttgatctcgaacgcagtgaacgatacgattaacgtgctgccgaccattaccgaaggtattccgattgtcagcaccattctggacggcatcaatctgggcgcggcgatcaaggagctgctggacgagcatgatccactgctgaaaaaggaattggaggcgaaagttggcgtcctggcgattaacatgtcgctgtccattgccgcaactgtcgcctcgattgtcggcattggcgcggaggtgacgatctttctgctgccaattgcgggtatctctgcaggcattccgtccttggttaacaacgagctgattctgcacgacaaggccacctctgtggttaactactttaatcatctgagcgagtcgaagaaatatggtcctctgaagaccgaagatgataagattctggtgccgatcgacgatttggtgatcagcgagattgactttaacaacaactcgatcaagctgggtacctgtaatatcctggctatggagggtggctcgggtcacaccgtcacgggtaatatcgaccacttcttcagcagcccgagcattagctcgcacattccgtctctgtcgatttactcggccatcggtatcgaaaccgagaacctggactttagcaagaagatcatgatgctgccaaatgcaccttctcgtgtcttttggtgggaaacgggcgctgttccaggcctgcgttctctggaaaacgatggtacccgcttgctggactcgatccgcgatttgtacccgggcaaattctactggcgtttctatgcgttctttgactacgcgattaccaccctgaagccagtttacgaggataccaacatcaaaattaagctggataaagatactcgtaactttattatgccgacgatcaccacgaacgagattcgcaacaaactgtcctattctttcgacggtgcgggcggtacctatagcttgctgctgagctcttacccgatctccacgaatattaacctgagcaaggacgatttgtggatcttcaacattgataacgaggtgcgtgagatctctatcgagaatggtacgattaagaagggtaagctgatcaaagacgttctgagcaaaattgacattaacaagaataagctgattattggcaaccagaccattgatttttcgggcgacatcgataacaaggaccgctacattttcctgacttgcgaactggatgacaagatcagcttgattatcgaaattaatctggtcgccaaaagctactccttgttgctgtccggcgacaaaaactatctgatctctaacctgtcgaatacgatcgaaaagattaacactctgggtctggacagcaagaacatcgcgtataactataccgacgagtctaacaacaagtatttcggtgcaatctcgaagacgagccagaagtcgatcatccactacaaaaaggactctaagaacattctggagttctataacgactctaccttggaattcaattcgaaggattttatcgccgaagacatcaacgtgttcatgaaggatgatatcaatacgatcaccggtaagtactatgtcgataataacaccgataaatccattgacttcagcatctcgctggtttctaaaaaccaagtgaaggttaacggtctgtatctgaatgagagcgtttattcctcctatttggactttgtgaaaaacagcgacggtcatcataacacctccaactttatgaacctgtttctggacaacatttccttctggaaactgtttggcttcgagaatattaactttgtgattgacaaatactttactctggttggtaaaaccaacctgggttacgtggagtttatctgcgacaacaataagaatatcgacatctacttcggtgaatggaaaaccagcagctccaagagcaccatcttctctggtaacggccgtaacgtggtcgtggagccgatttacaatccggacactggcgaagatatttccacttctctggatttcagctatgaaccgctgtatggcattgatcgctacatcaataaagtgctgattgcgccagatctgtacacgagcctgatcaatattaacacgaattactactccaacgagtattacccggagattattgtgttgaacccgaatacctttcacaagaaagtgaacattaacttggatagctccagctttgaatacaaatggtcgacggagggctccgatttcattctggtccgttacctggaggagtccaacaagaagattttgcagaaaatccgtattaaaggcatcctgagcaatacccagagcttcaacaagatgtccatcgactttaaagacattaagaagctgtcgttgggctatatcatgtcgaattttaagagctttaactccgaaaacgaactggaccgtgatcatctgggctttaagatcattgataataagacctattactacgacgaagacagcaagctggtcaaaggcctgattaatatcaacaacagcttgttctactttgatccaattgagtttaacctggtcacgggttggcaaaccattaacggtaaaaagtattactttgacatcaatacgggcgcagctctgactagttacaaaatcattaacggcaaacatttctacttcaataacgacggcgttatgcagctgggtgttttcaaaggtccggatggttttgaatactttgccccggcaaacacccaaaacaacaacatcgaaggtcaggcaatcgtttatcagtccaaatttctgaccctgaacggtaaaaagtattacttcgacaacaattccaaagccgtaaccggttggcgcattattaacaacgagaagtactatttcaacccgaacaacgcgattgccgctgtgggcctgcaggttatcgacaacaacaaatattactttaacccggataccgcgatcatttccaaaggctggcagactgttaacggtagccgttactacttcgacacggataccgctattgcattcaacggttataaaaccattgatggcaaacacttctactttgattctgactgtgttgtgaaaatcggcgttttctctacctccaacggctttgaatacttcgctccggctaatacctacaacaataacatcgaaggtcaggccatcgtgtaccagtctaaattcctgaccctgaacggtaagaaatactatttcgacaacaactctaaagccgttaccggcctgcagaccatcgacagcaaaaagtactacttcaacactaacacggcggaagcagcgactggttggcagaccatcgacggcaaaaagtactattttaacactaatactgcggaggctgcgaccggctggcaaactatcgacggtaagaaatactactttaacaccaataccgctattgcttctaccggctacactatcatcaacggtaaacacttctatttcaacaccgatggtatcatgcagatcggtgtttttaaaggtcctaacggcttcgaatacttcgctccggcgaacaccgacgctaacaacattgaaggccaggctatcctgtaccagaatgaatttctgaccctgaacggcaagaaatattactttggttctgattctaaagccgtgaccggttggcgtatcatcaacaacaagaaatattacttcaacccgaacaacgcgattgcggctatccacctgtgcacgatcaacaacgacaaatactacttctcctatgatggcatcctgcagaacggttacatcaccattgagcgcaacaacttttacttcgacgcgaacaatgaatctaaaatggtaaccggtgtttttaaaggcccgaacggttttgagtactttgccccagcgaacacccataacaacaatattgagggccaggcgattgtatatcagaacaaatttctgactctgaacggcaagaaatactacttcgacaacgacagcaaagcggttactggctggcagaccattgatggcaaaaagtactatttcaacctgaacactgcagaagctgcgacgggctggcagactattgatggtaagaaatactacttcaacctgaacactgctgaagctgcgactggctggcagacgatcgacggcaagaaatattacttcaacaccaacaccttcatcgcgagcactggttatacgagcatcaacggtaaacacttctacttcaacaccgatggcattatgcagatcggtgtattcaaaggcccgaacggcttcgaatatttcgcaccggcgaacactgatgccaacaatatcgaaggtcaggcaatcctgtaccagaacaaatttctgaccctgaacggcaagaaatactattttggttctgactctaaggcagtaaccggtctgcgtacgatcgacggcaaaaagtactacttcaacactaacaccgcagtggccgttaccggttggcagaccatcaacggcaagaaatactactttaacaccaatactagcatcgcttctaccggttacaccatcatctccggcaagcacttctacttcaacaccgatggtattatgcagatcggtgtgttcaaaggtcctgatggtttcgaatacttcgctcctgccaacacggacgctaataacatcgagggccaggccattcgttaccaaaaccgcttcctgtatctgcatgacaacatctactactttggtaacaactccaaagcggcgaccggttgggttaccattgatggcaaccgttactattttgaaccgaacactgcgatgggcgcgaatggttataaaaccattgacaacaaaaacttctacttccgtaacggcctgccgcagattggcgtgttcaaaggttctaatggcttcgaatacttcgcaccggctaatacggacgcgaacaacattgaaggtcaggctatccgctaccagaaccgtttcctgcatctgctgggcaagatctactacttcggcaacaactctaaagctgttaccggctggcagacgattaatggtaaagtctactacttcatgccggataccgcaatggcagcagctggtggtctgttcgagattgatggcgtaatctatttcttcggcgtggacggtgttaaagctccgggtatttatggcctcgagcaccaccaccaccaccactga

SEQ ID NO: 6 - DNA, 8157 bp, Artificial Sequence
  VPI 10463 strain, E. coli optimized, W101A, D287A, E514Q, W519A TcdA (Quad W519)
atgtcgctgattagcaaggaagagctgattaagttggcgtatagcattcgcccgcgcgagaacgaatataagacgatcctgaccaacttggatgagtataataaattgactacgaacaataacgagaacaagtatttgcagctgaagaaactgaatgagtccatcgacgtctttatgaataagtacaaaacgtcttcgcgcaaccgcgccttgtctaacctgaagaaggacattttgaaggaggtcattctgattaagaatagcaatacgagcccggttgaaaagaacctgcattttgtcgccattggcggtgaagttagcgacattgcgctggaatatatcaagcaatgggcagacattaacgcggagtataacatcaagttgtggtacgactctgaggcatttttggttaacactttgaaaaaggccatcgtggagagcagcacgactgaagcgttgcaattgctggaggaagagatccagaatccgcagtttgacaatatgaaattctacaagaaacgcatggagttcatttatgaccgtcaaaaacgcttcattaactactataaatcccaaatcaacaaaccgaccgttccaacgatcgatgacattatcaaatcccacctggtgtcggagtacaatcgcgacgaaaccgttctggagtcctaccgcaccaacagcctgcgcaaaatcaatagcaatcatggcattgatattcgtgctaactcgttgttcactgaacaggaactgttgaatatttacagccaggagttgttgaaccgtggtaacctggcggcggcgtcggacatcgttcgcttgctggcgctgaagaacttcggtggtgtttatctggatgttgccatgctgccgggcattcactctgacttgtttaaaaccattagccgtccatccagcatcggcctggatcgttgggagatgattaaactggaagccatcatgaagtataagaaatacatcaacaactacacctcggaaaacttcgataaattggatcaacaattgaaagataactttaagctgattatcgagagcaagtctgaaaagagcgaaattttcagcaaactggagaacctgaatgtgagcgacctggagattaagattgcgttcgcgctgggttcggttatcaaccaggcactgatcagcaaacaaggctcctatttgacgaacttggtgatcgagcaggtcaaaaaccgctaccaattcctgaaccaacatctgaatccggccatcgaatccgataataactttacggacaccaccaagattttccatgactctctgtttaactccgcgaccgccgaaaattctatgtttctgaccaaaatcgccccttatttgcaagtcggcttcatgccggaggctcgcagcacgatcagcttgtctggtccgggcgcttatgcgtccgcgtattacgatttcatcaacttgcaggaaaacaccatcgagaaaaccctgaaggccagcgacctgattgagtttaagtttccagagaacaatctgagccaactgaccgaacagcaaatcaattccctggcgagctttgaccaagcgagcgcaaaatatcaattcgaaaagtacgtgcgtgactataccggtggtagcctgagcgaagacaacggcgttgattttaacaagaatacggcgctggataaaaactatctgctgaataataagatcccgtcgaacaacgttgaagaggctggcagcaaaaactacgtgcattacattatccaactgcaaggtgacgacatcagctatgaggccacgtgcaacctgtttagcaagaatccgaaaaactcgatcatcattcaacgcaacatgaacgagtcggcgaagagctatttcctgtctgatgacggcgagtcgattctggagctgaacaagtaccgcattccggagcgtctgaagaacaaggagaaggtcaaagttaccttcattggtcacggcaaggacgagttcaatacctccgagtttgcacgcctgtccgttgacagcttgagcaatgagattagcagctttctggacacgatcaagttggacatctctccgaaaaatgtggaggtgaacctgctgggctgcaatatgttttcctacgattttaacgttgaggaaacttatccgggtaagttgctgctgagcattatggataagattacgagcaccttgccagacgttaacaaaaactccattaccattggcgcaaatcaatatgaggtgcgtattaattcggagggtcgcaaagagctgctggcccatagcggcaaatggattaataaggaagaggctattatgtctgatctgtcttccaaggagtacatcttctttgattccattgacaataagctgaaagcgaagtcgaaaaacatcccgggtttggcatcgattagcgaggatatcaagaccttgctgttggatgcgtcggtttcgccggataccaagtttatcctgaacaatttgaagcttaacattgagagctcgatcggcgactacatttactatgagaaactggaaccggtgaagaatatcatccacaactctatcgatgacttgatcgatgaattcaacttgctggagaacgtgtccgatgagctgtatgagctgaaaaagttgaacaacctggacgagaagtatttgattagctttgaggacatttcgaaaaataactccacctatagcgtccgctttatcaacaaaagcaacggtgaatctgtgtacgtggagactgagaaggagattttcagcaagtatagcgagcatattaccaaggaaatttctaccattaaaaactccattatcacggatgtcaacggcaacctgttggataatatccagttggaccatactagccaggtgaataccctgaatgcggccttcttcatccaaagcctgattgattatagctccaacaaggacgtgttgaatgatctgagcacgtccgttaaggtgcaattgtacgcgcagttgttcagcacgggtctgaatacgatttacgatagcattcaattggttaatttgatctcgaacgcagtgaacgatacgattaacgtgctgccgaccattaccgaaggtattccgattgtcagcaccattctggacggcatcaatctgggcgcggcgatcaaggagctgctggacgagcatgatccactgctgaaaaaggaattggaggcgaaagttggcgtcctggcgattaacatgtcgctgtccattgccgcaactgtcgcctcgattgtcggcattggcgcggaggtgacgatctttctgctgccaattgcgggtatctctgcaggcattccgtccttggttaacaacgagctgattctgcacgacaaggccacctctgtggttaactactttaatcatctgagcgagtcgaagaaatatggtcctctgaagaccgaagatgataagattctggtgccgatcgacgatttggtgatcagcgagattgactttaacaacaactcgatcaagctgggtacctgtaatatcctggctatggagggtggctcgggtcacaccgtcacgggtaatatcgaccacttcttcagcagcccgagcattagctcgcacattccgtctctgtcgatttactcggccatcggtatcgaaaccgagaacctggactttagcaagaagatcatgatgctgccaaatgcaccttctcgtgtcttttggtgggaaacgggcgctgttccaggcctgcgttctctggaaaacgatggtacccgcttgctggactcgatccgcgatttgtacccgggcaaattctactggcgtttctatgcgttctttgactacgcgattaccaccctgaagccagtttacgaggataccaacatcaaaattaagctggataaagatactcgtaactttattatgccgacgatcaccacgaacgagattcgcaacaaactgtcctattctttcgacggtgcgggcggtacctatagcttgctgctgagctcttacccgatctccacgaatattaacctgagcaaggacgatttgtggatcttcaacattgataacgaggtgcgtgagatctctatcgagaatggtacgattaagaagggtaagctgatcaaagacgttctgagcaaaattgacattaacaagaataagctgattattggcaaccagaccattgatttttcgggcgacatcgataacaaggaccgctacattttcctgacttgcgaactggatgacaagatcagcttgattatcgaaattaatctggtcgccaaaagctactccttgttgctgtccggcgacaaaaactatctgatctctaacctgtcgaatacgatcgaaaagattaacactctgggtctggacagcaagaacatcgcgtataactataccgacgagtctaacaacaagtatttcggtgcaatctcgaagacgagccagaagtcgatcatccactacaaaaaggactctaagaacattctggagttctataacgactctaccttggaattcaattcgaaggattttatcgccgaagacatcaacgtgttcatgaaggatgatatcaatacgatcaccggtaagtactatgtcgataataacaccgataaatccattgacttcagcatctcgctggtttctaaaaaccaagtgaaggttaacggtctgtatctgaatgagagcgtttattcctcctatttggactttgtgaaaaacagcgacggtcatcataacacctccaactttatgaacctgtttctggacaacatttccttctggaaactgtttggcttcgagaatattaactttgtgattgacaaatactttactctggttggtaaaaccaacctgggttacgtggagtttatctgcgacaacaataagaatatcgacatctacttcggtgaatggaaaaccagcagctccaagagcaccatcttctctggtaacggccgtaacgtggtcgtggagccgatttacaatccggacactggcgaagatatttccacttctctggatttcagctatgaaccgctgtatggcattgatcgctacatcaataaagtgctgattgcgccagatctgtacacgagcctgatcaatattaacacgaattactactccaacgagtattacccggagattattgtgttgaacccgaatacctttcacaagaaagtgaacattaacttggatagctccagctttgaatacaaatggtcgacggagggctccgatttcattctggtccgttacctggaggagtccaacaagaagattttgcagaaaatccgtattaaaggcatcctgagcaatacccagagcttcaacaagatgtccatcgactttaaagacattaagaagctgtcgttgggctatatcatgtcgaattttaagagctttaactccgaaaacgaactggaccgtgatcatctgggctttaagatcattgataataagacctattactacgacgaagacagcaagctggtcaaaggcctgattaatatcaacaacagcttgttctactttgatccaattgagtttaacctggtcacgggttggcaaaccattaacggtaaaaagtattactttgacatcaatacgggcgcagctctgactagttacaaaatcattaacggcaaacatttctacttcaataacgacggcgttatgcagctgggtgttttcaaaggtccggatggttttgaatactttgccccggcaaacacccaaaacaacaacatcgaaggtcaggcaatcgtttatcagtccaaatttctgaccctgaacggtaaaaagtattacttcgacaacaattccaaagccgtaaccggttggcgcattattaacaacgagaagtactatttcaacccgaacaacgcgattgccgctgtgggcctgcaggttatcgacaacaacaaatattactttaacccggataccgcgatcatttccaaaggctggcagactgttaacggtagccgttactacttcgacacggataccgctattgcattcaacggttataaaaccattgatggcaaacacttctactttgattctgactgtgttgtgaaaatcggcgttttctctacctccaacggctttgaatacttcgctccggctaatacctacaacaataacatcgaaggtcaggccatcgtgtaccagtctaaattcctgaccctgaacggtaagaaatactatttcgacaacaactctaaagccgttaccggcctgcagaccatcgacagcaaaaagtactacttcaacactaacacggcggaagcagcgactggttggcagaccatcgacggcaaaaagtactattttaacactaatactgcggaggctgcgaccggctggcaaactatcgacggtaagaaatactactttaacaccaataccgctattgcttctaccggctacactatcatcaacggtaaacacttctatttcaacaccgatggtatcatgcagatcggtgtttttaaaggtcctaacggcttcgaatacttcgctccggcgaacaccgacgctaacaacattgaaggccaggctatcctgtaccagaatgaatttctgaccctgaacggcaagaaatattactttggttctgattctaaagccgtgaccggttggcgtatcatcaacaacaagaaatattacttcaacccgaacaacgcgattgcggctatccacctgtgcacgatcaacaacgacaaatactacttctcctatgatggcatcctgcagaacggttacatcaccattgagcgcaacaacttttacttcgacgcgaacaatgaatctaaaatggtaaccggtgtttttaaaggcccgaacggttttgagtactttgccccagcgaacacccataacaacaatattgagggccaggcgattgtatatcagaacaaatttctgactctgaacggcaagaaatactacttcgacaacgacagcaaagcggttactggctggcagaccattgatggcaaaaagtactatttcaacctgaacactgcagaagctgcgacgggctggcagactattgatggtaagaaatactacttcaacctgaacactgctgaagctgcgactggctggcagacgatcgacggcaagaaatattacttcaacaccaacaccttcatcgcgagcactggttatacgagcatcaacggtaaacacttctacttcaacaccgatggcattatgcagatcggtgtattcaaaggcccgaacggcttcgaatatttcgcaccggcgaacactgatgccaacaatatcgaaggtcaggcaatcctgtaccagaacaaatttctgaccctgaacggcaagaaatactattttggttctgactctaaggcagtaaccggtctgcgtacgatcgacggcaaaaagtactacttcaacactaacaccgcagtggccgttaccggttggcagaccatcaacggcaagaaatactactttaacaccaatactagcatcgcttctaccggttacaccatcatctccggcaagcacttctacttcaacaccgatggtattatgcagatcggtgtgttcaaaggtcctgatggtttcgaatacttcgctcctgccaacacggacgctaataacatcgagggccaggccattcgttaccaaaaccgcttcctgtatctgcatgacaacatctactactttggtaacaactccaaagcggcgaccggttgggttaccattgatggcaaccgttactattttgaaccgaacactgcgatgggcgcgaatggttataaaaccattgacaacaaaaacttctacttccgtaacggcctgccgcagattggcgtgttcaaaggttctaatggcttcgaatacttcgcaccggctaatacggacgcgaacaacattgaaggtcaggctatccgctaccagaaccgtttcctgcatctgctgggcaagatctactacttcggcaacaactctaaagctgttaccggctggcagacgattaatggtaaagtctactacttcatgccggataccgcaatggcagcagctggtggtctgttcgagattgatggcgtaatctatttcttcggcgtggacggtgttaaagctccgggtatttatggcctcgagcaccaccaccaccaccactga

SEQ ID NO: 7 - protein, 2711 aa, Artificial Sequence
  VPI 10463 strain, W101A, D287A, E514Q TcdA (Tri)
MGSLISKEELIKLAYSIRPRENEYKTILTNLDEYNKLTTNNNENKYLQLKKLNESIDVFMNKYKTSSRNRALSNLKKDILKEVILIKNSNTSPVEKNLHFVAIGGEVSDIALEYIKQWADINAEYNIKLWYDSEAFLVNTLKKAIVESSTTEALQLLEEEIQNPQFDNMKFYKKRMEFIYDRQKRFINYYKSQINKPTVPTIDDIIKSHLVSEYNRDETVLESYRTNSLRKINSNHGIDIRANSLFTEQELLNIYSQELLNRGNLAAASDIVRLLALKNFGGVYLDVAMLPGIHSDLFKTISRPSSIGLDRWEMIKLEAIMKYKKYINNYTSENFDKLDQQLKDNFKLIIESKSEKSEIFSKLENLNVSDLEIKIAFALGSVINQALISKQGSYLTNLVIEQVKNRYQFLNQHLNPAIESDNNFTDTTKIFHDSLFNSATAENSMFLTKIAPYLQVGFMPEARSTISLSGPGAYASAYYDFINLQENTIEKTLKASDLIEFKFPENNLSQLTEQQINSLWSFDQASAKYQFEKYVRDYTGGSLSEDNGVDFNKNTALDKNYLLNNKIPSNNVEEAGSKNYVHYIIQLQGDDISYEATCNLFSKNPKNSIIIQRNMNESAKSYFLSDDGESILELNKYRIPERLKNKEKVKVTFIGHGKDEFNTSEFARLSVDSLSNEISSFLDTIKLDISPKNVEVNLLGCNMFSYDFNVEETYPGKLLLSIMDKITSTLPDVNKNSITIGANQYEVRINSEGRKELLAHSGKWINKEEAIMSDLSSKEYIFFDSIDNKLKAKSKNIPGLASISEDIKTLLLDASVSPDTKFILNNLKLNIESSIGDYIYYEKLEPVKNIIHNSIDDLIDEFNLLENVSDELYELKKLNNLDEKYLISFEDISKNNSTYSVRFINKSNGESVYVETEKEIFSKYSEHITKEISTIKNSIITDVNGNLLDNIQLDHTSQVNTLNAAFFIQSLIDYSSNKDVLNDLSTSVKVQLYAQLFSTGLNTIYDSIQLVNLISNAVNDTINVLPTITEGIPIVSTILDGINLGAAIKELLDEHDPLLKKELEAKVGVLAINMSLSIAATVASIVGIGAEVTIFLLPIAGISAGIPSLVNNELILHDKATSVVNYFNHLSESKKYGPLKTEDDKILVPIDDLVISEIDFNNNSIKLGTCNILAMEGGSGHTVTGNIDHFFSSPSISSHIPSLSIYSAIGIETENLDFSKKIMMLPNAPSRVFWWETGAVPGLRSLENDGTRLLDSIRDLYPGKFYWRFYAFFDYAITTLKPVYEDTNIKIKLDKDTRNFIMPTITTNEIRNKLSYSFDGAGGTYSLLLSSYPISTNINLSKDDLWIFNIDNEVREISIENGTIKKGKLIKDVLSKIDINKNKLIIGNQTIDFSGDIDNKDRYIFLTCELDDKISLIIEINLVAKSYSLLLSGDKNYLISNLSNTIEKINTLGLDSKNIAYNYTDESNNKYFGAISKTSQKSIIHYKKDSKNILEFYNDSTLEFNSKDFIAEDINVFMKDDINTITGKYYVDNNTDKSIDFSISLVSKNQVKVNGLYLNESVYSSYLDFVKNSDGHHNTSNFMNLFLDNISFWKLFGFENINFVIDKYFTLVGKTNLGYVEFICDNNKNIDIYFGEWKTSSSKSTIFSGNGRNVVVEPIYNPDTGEDISTSLDFSYEPLYGIDRYINKVLIAPDLYTSLININTNYYSNEYYPEIIVLNPNTFHKKVNINLDSSSFEYKWSTEGSDFILVRYLEESNKKILQKIRIKGILSNTQSFNKMSIDFKDIKKLSLGYIMSNFKSFNSENELDRDHLGFKIIDNKTYYYDEDSKLVKGLININNSLFYFDPIEFNLVTGWQTINGKKYYFDINTGAALTSYKIINGKHFYFNNDGVMQLGVFKGPDGFEYFAPANTQNNNIEGQAIVYQSKFLTLNGKKYYFDNNSKAVTGWRIINNEKYYFNPNNAIAAVGLQVIDNNKYYFNPDTAIISKGWQTVNGSRYYFDTDTAIAFNGYKTIDGKHFYFDSDCVVKIGVFSTSNGFEYFAPANTYNNNIEGQAIVYQSKFLTLNGKKYYFDNNSKAVTGLQTIDSKKYYFNTNTAEAATGWQTIDGKKYYFNTNTAEAATGWQTIDGKKYYFNTNTAIASTGYTIINGKHFYFNTDGIMQIGVFKGPNGFEYFAPANTDANNIEGQAILYQNEFLTLNGKKYYFGSDSKAVTGWRIINNKKYYFNPNNAIAAIHLCTINNDKYYFSYDGILQNGYITIERNNFYFDANNESKMVTGVFKGPNGFEYFAPANTHNNNIEGQAIVYQNKFLTLNGKKYYFDNDSKAVTGWQTIDGKKYYFNLNTAEAATGWQTIDGKKYYFNLNTAEAATGWQTIDGKKYYFNTNTFIASTGYTSINGKHFYFNTDGIMQIGVFKGPNGFEYFAPANTDANNIEGQAILYQNKFLTLNGKKYYFGSDSKAVTGLRTIDGKKYYFNTNTAVAVTGWQTINGKKYYFNTNTSIASTGYTIISGKHFYFNTDGIMQIGVFKGPDGFEYFAPANTDANNIEGQAIRYQNRFLYLHDNIYYFGNNSKAATGWVTIDGNRYYFEPNTAMGANGYKTIDNKNFYFRNGLPQIGVFKGSNGFEYFAPANTDANNIEGQAIRYQNRFLHLLGKIYYFGNNSKAVTGWQTINGKVYYFMPDTAMAAAGGLFEIDGVIYFFGVDGVKAPGIYG

SEQ ID NO: 8 - protein, 2710 aa, Artificial Sequence
  VPI 10463 strain, TcdA (W101Del)
MGSLISKEELIKLAYSIRPRENEYKTILTNLDEYNKLTTNNNENKYLQLKKLNESIDVFMNKYKTSSRNRALSNLKKDILKEVILIKNSNTSPVEKNLHFVIGGEVSDIALEYIKQWADINAEYNIKLWYDSEAFLVNTLKKAIVESSTTEALQLLEEEIQNPQFDNMKFYKKRMEFIYDRQKRFINYYKSQINKPTVPTIDDIIKSHLVSEYNRDETVLESYRTNSLRKINSNHGIDIRANSLFTEQELLNIYSQELLNRGNLAAASDIVRLLALKNFGGVYLDVDMLPGIHSDLFKTISRPSSIGLDRWEMIKLEAIMKYKKYINNYTSENFDKLDQQLKDNFKLIIESKSEKSEIFSKLENLNVSDLEIKIAFALGSVINQALISKQGSYLTNLVIEQVKNRYQFLNQHLNPAIESDNNFTDTTKIFHDSLFNSATAENSMFLTKIAPYLQVGFMPEARSTISLSGPGAYASAYYDFINLQENTIEKTLKASDLIEFKFPENNLSQLTEQEINSLWSFDQASAKYQFEKYVRDYTGGSLSEDNGVDFNKNTALDKNYLLNNKIPSNNVEEAGSKNYVHYIIQLQGDDISYEATCNLFSKNPKNSIIIQRNMNESAKSYFLSDDGESILELNKYRIPERLKNKEKVKVTFIGHGKDEFNTSEFARLSVDSLSNEISSFLDTIKLDISPKNVEVNLLGCNMFSYDFNVEETYPGKLLLSIMDKITSTLPDVNKNSITIGANQYEVRINSEGRKELLAHSGKWINKEEAIMSDLSSKEYIFFDSIDNKLKAKSKNIPGLASISEDIKTLLLDASVSPDTKFILNNLKLNIESSIGDYIYYEKLEPVKNIIHNSIDDLIDEFNLLENVSDELYELKKLNNLDEKYLISFEDISKNNSTYSVRFINKSNGESVYVETEKEIFSKYSEHITKEISTIKNSIITDVNGNLLDNIQLDHTSQVNTLNAAFFIQSLIDYSSNKDVLNDLSTSVKVQLYAQLFSTGLNTIYDSIQLVNLISNAVNDTINVLPTITEGIPIVSTILDGINLGAAIKELLDEHDPLLKKELEAKVGVLAINMSLSIAATVASIVGIGAEVTIFLLPIAGISAGIPSLVNNELILHDKATSVVNYFNHLSESKKYGPLKTEDDKILVPIDDLVISEIDFNNNSIKLGTCNILAMEGGSGHTVTGNIDHFFSSPSISSHIPSLSIYSAIGIETENLDFSKKIMMLPNAPSRVFWWETGAVPGLRSLENDGTRLLDSIRDLYPGKFYWRFYAFFDYAITTLKPVYEDTNIKIKLDKDTRNFIMPTITTNEIRNKLSYSFDGAGGTYSLLLSSYPISTNINLSKDDLWIFNIDNEVREISIENGTIKKGKLIKDVLSKIDINKNKLIIGNQTIDFSGDIDNKDRYIFLTCELDDKISLIIEINLVAKSYSLLLSGDKNYLISNLSNTIEKINTLGLDSKNIAYNYTDESNNKYFGAISKTSQKSIIHYKKDSKNILEFYNDSTLEFNSKDFIAEDINVFMKDDINTITGKYYVDNNTDKSIDFSISLVSKNQVKVNGLYLNESVYSSYLDFVKNSDGHHNTSNFMNLFLDNISFWKLFGFENINFVIDKYFTLVGKTNLGYVEFICDNNKNIDIYFGEWKTSSSKSTIFSGNGRNVVVEPIYNPDTGEDISTSLDFSYEPLYGIDRYINKVLIAPDLYTSLININTNYYSNEYYPEIIVLNPNTFHKKVNINLDSSSFEYKWSTEGSDFILVRYLEESNKKILQKIRIKGILSNTQSFNKMSIDFKDIKKLSLGYIMSNFKSFNSENELDRDHLGFKIIDNKTYYYDEDSKLVKGLININNSLFYFDPIEFNLVTGWQTINGKKYYFDINTGAALTSYKIINGKHFYFNNDGVMQLGVFKGPDGFEYFAPANTQNNNIEGQAIVYQSKFLTLNGKKYYFDNNSKAVTGWRIINNEKYYFNPNNAIAAVGLQVIDNNKYYFNPDTAIISKGWQTVNGSRYYFDTDTAIAFNGYKTIDGKHFYFDSDCVVKIGVFSTSNGFEYFAPANTYNNNIEGQAIVYQSKFLTLNGKKYYFDNNSKAVTGLQTIDSKKYYFNTNTAEAATGWQTIDGKKYYFNTNTAEAATGWQTIDGKKYYFNTNTAIASTGYTIINGKHFYFNTDGIMQIGVFKGPNGFEYFAPANTDANNIEGQAILYQNEFLTLNGKKYYFGSDSKAVTGWRIINNKKYYFNPNNAIAAIHLCTINNDKYYFSYDGILQNGYITIERNNFYFDANNESKMVTGVFKGPNGFEYFAPANTHNNNIEGQAIVYQNKFLTLNGKKYYFDNDSKAVTGWQTIDGKKYYFNLNTAEAATGWQTIDGKKYYFNLNTAEAATGWQTIDGKKYYFNTNTFIASTGYTSINGKHFYFNTDGIMQIGVFKGPNGFEYFAPANTDANNIEGQAILYQNKFLTLNGKKYYFGSDSKAVTGLRTIDGKKYYFNTNTAVAVTGWQTINGKKYYFNTNTSIASTGYTIISGKHFYFNTDGIMQIGVFKGPDGFEYFAPANTDANNIEGQAIRYQNRFLYLHDNIYYFGNNSKAATGWVTIDGNRYYFEPNTAMGANGYKTIDNKNFYFRNGLPQIGVFKGSNGFEYFAPANTDANNIEGQAIRYQNRFLHLLGKIYYFGNNSKAVTGWQTINGKVYYFMPDTAMAAAGGLFEIDGVIYFFGVDGVKAPGIYG

SEQ ID NO: 9 - protein, 2710 aa, Artificial Sequence
  VPI 10463 strain, W101A, D287A, E514Q TcdA (Tri)
MSLISKEELIKLAYSIRPRENEYKTILTNLDEYNKLTTNNNENKYLQLKKLNESIDVFMNKYKTSSRNRALSNLKKDILKEVILIKNSNTSPVEKNLHFVAIGGEVSDIALEYIKQWADINAEYNIKLWYDSEAFLVNTLKKAIVESSTTEALQLLEEEIQNPQFDNMKFYKKRMEFIYDRQKRFINYYKSQINKPTVPTIDDIIKSHLVSEYNRDETVLESYRTNSLRKINSNHGIDIRANSLFTEQELLNIYSQELLNRGNLAAASDIVRLLALKNFGGVYLDVAMLPGIHSDLFKTISRPSSIGLDRWEMIKLEAIMKYKKYINNYTSENFDKLDQQLKDNFKLIIESKSEKSEIFSKLENLNVSDLEIKIAFALGSVINQALISKQGSYLTNLVIEQVKNRYQFLNQHLNPAIESDNNFTDTTKIFHDSLFNSATAENSMFLTKIAPYLQVGFMPEARSTISLSGPGAYASAYYDFINLQENTIEKTLKASDLIEFKFPENNLSQLTEQQINSLWSFDQASAKYQFEKYVRDYTGGSLSEDNGVDFNKNTALDKNYLLNNKIPSNNVEEAGSKNYVHYIIQLQGDDISYEATCNLFSKNPKNSIIIQRNMNESAKSYFLSDDGESILELNKYRIPERLKNKEKVKVTFIGHGKDEFNTSEFARLSVDSLSNEISSFLDTIKLDISPKNVEVNLLGCNMFSYDFNVEETYPGKLLLSIMDKITSTLPDVNKNSITIGANQYEVRINSEGRKELLAHSGKWINKEEAIMSDLSSKEYIFFDSIDNKLKAKSKNIPGLASISEDIKTLLLDASVSPDTKFILNNLKLNIESSIGDYIYYEKLEPVKNIIHNSIDDLIDEFNLLENVSDELYELKKLNNLDEKYLISFEDISKNNSTYSVRFINKSNGESVYVETEKEIFSKYSEHITKEISTIKNSIITDVNGNLLDNIQLDHTSQVNTLNAAFFIQSLIDYSSNKDVLNDLSTSVKVQLYAQLFSTGLNTIYDSIQLVNLISNAVNDTINVLPTITEGIPIVSTILDGINLGAAIKELLDEHDPLLKKELEAKVGVLAINMSLSIAATVASIVGIGAEVTIFLLPIAGISAGIPSLVNNELILHDKATSVVNYFNHLSESKKYGPLKTEDDKILVPIDDLVISEIDFNNNSIKLGTCNILAMEGGSGHTVTGNIDHFFSSPSISSHIPSLSIYSAIGIETENLDFSKKIMMLPNAPSRVFWWETGAVPGLRSLENDGTRLLDSIRDLYPGKFYWRFYAFFDYAITTLKPVYEDTNIKIKLDKDTRNFIMPTITTNEIRNKLSYSFDGAGGTYSLLLSSYPISTNINLSKDDLWIFNIDNEVREISIENGTIKKGKLIKDVLSKIDINKNKLIIGNQTIDFSGDIDNKDRYIFLTCELDDKISLIIEINLVAKSYSLLLSGDKNYLISNLSNTIEKINTLGLDSKNIAYNYTDESNNKYFGAISKTSQKSIIHYKKDSKNILEFYNDSTLEFNSKDFIAEDINVFMKDDINTITGKYYVDNNTDKSIDFSISLVSKNQVKVNGLYLNESVYSSYLDFVKNSDGHHNTSNFMNLFLDNISFWKLFGFENINFVIDKYFTLVGKTNLGYVEFICDNNKNIDIYFGEWKTSSSKSTIFSGNGRNVVVEPIYNPDTGEDISTSLDFSYEPLYGIDRYINKVLIAPDLYTSLININTNYYSNEYYPEIIVLNPNTFHKKVNINLDSSSFEYKWSTEGSDFILVRYLEESNKKILQKIRIKGILSNTQSFNKMSIDFKDIKKLSLGYIMSNFKSFNSENELDRDHLGFKIIDNKTYYYDEDSKLVKGLININNSLFYFDPIEFNLVTGWQTINGKKYYFDINTGAALTSYKIINGKHFYFNNDGVMQLGVFKGPDGFEYFAPANTQNNNIEGQAIVYQSKFLTLNGKKYYFDNNSKAVTGWRIINNEKYYFNPNNAIAAVGLQVIDNNKYYFNPDTAIISKGWQTVNGSRYYFDTDTAIAFNGYKTIDGKHFYFDSDCVVKIGVFSTSNGFEYFAPANTYNNNIEGQAIVYQSKFLTLNGKKYYFDNNSKAVTGLQTIDSKKYYFNTNTAEAATGWQTIDGKKYYFNTNTAEAATGWQTIDGKKYYFNTNTAIASTGYTIINGKHFYFNTDGIMQIGVFKGPNGFEYFAPANTDANNIEGQAILYQNEFLTLNGKKYYFGSDSKAVTGWRIINNKKYYFNPNNAIAAIHLCTINNDKYYFSYDGILQNGYITIERNNFYFDANNESKMVTGVFKGPNGFEYFAPANTHNNNIEGQAIVYQNKFLTLNGKKYYFDNDSKAVTGWQTIDGKKYYFNLNTAEAATGWQTIDGKKYYFNLNTAEAATGWQTIDGKKYYFNTNTFIASTGYTSINGKHFYFNTDGIMQIGVFKGPNGFEYFAPANTDANNIEGQAILYQNKFLTLNGKKYYFGSDSKAVTGLRTIDGKKYYFNTNTAVAVTGWQTINGKKYYFNTNTSIASTGYTIISGKHFYFNTDGIMQIGVFKGPDGFEYFAPANTDANNIEGQAIRYQNRFLYLHDNIYYFGNNSKAATGWVTIDGNRYYFEPNTAMGANGYKTIDNKNFYFRNGLPQIGVFKGSNGFEYFAPANTDANNIEGQAIRYQNRFLHLLGKIYYFGNNSKAVTGWQTINGKVYYFMPDTAMAAAGGLFEIDGVIYFFGVDGVKAPGIYG

SEQ ID NO: 10 - protein, 2710 aa, Artificial Sequence
  VPI 10463 strain, W101A, D285A, D287A, E514Q TcdA (Quad D285)
MSLISKEELIKLAYSIRPRENEYKTILTNLDEYNKLTTNNNENKYLQLKKLNESIDVFMNKYKTSSRNRALSNLKKDILKEVILIKNSNTSPVEKNLHFVAIGGEVSDIALEYIKQWADINAEYNIKLWYDSEAFLVNTLKKAIVESSTTEALQLLEEEIQNPQFDNMKFYKKRMEFIYDRQKRFINYYKSQINKPTVPTIDDIIKSHLVSEYNRDETVLESYRTNSLRKINSNHGIDIRANSLFTEQELLNIYSQELLNRGNLAAASDIVRLLALKNFGGVYLAVAMLPGIHSDLFKTISRPSSIGLDRWEMIKLEAIMKYKKYINNYTSENFDKLDQQLKDNFKLIIESKSEKSEIFSKLENLNVSDLEIKIAFALGSVINQALISKQGSYLTNLVIEQVKNRYQFLNQHLNPAIESDNNFTDTTKIFHDSLFNSATAENSMFLTKIAPYLQVGFMPEARSTISLSGPGAYASAYYDFINLQENTIEKTLKASDLIEFKFPENNLSQLTEQQINSLWSFDQASAKYQFEKYVRDYTGGSLSEDNGVDFNKNTALDKNYLLNNKIPSNNVEEAGSKNYVHYIIQLQGDDISYEATCNLFSKNPKNSIIIQRNMNESAKSYFLSDDGESILELNKYRIPERLKNKEKVKVTFIGHGKDEFNTSEFARLSVDSLSNEISSFLDTIKLDISPKNVEVNLLGCNMFSYDFNVEETYPGKLLLSIMDKITSTLPDVNKNSITIGANQYEVRINSEGRKELLAHSGKWINKEEAIMSDLSSKEYIFFDSIDNKLKAKSKNIPGLASISEDIKTLLLDASVSPDTKFILNNLKLNIESSIGDYIYYEKLEPVKNIIHNSIDDLIDEFNLLENVSDELYELKKLNNLDEKYLISFEDISKNNSTYSVRFINKSNGESVYVETEKEIFSKYSEHITKEISTIKNSIITDVNGNLLDNIQLDHTSQVNTLNAAFFIQSLIDYSSNKDVLNDLSTSVKVQLYAQLFSTGLNTIYDSIQLVNLISNAVNDTINVLPTITEGIPIVSTILDGINLGAAIKELLDEHDPLLKKELEAKVGVLAINMSLSIAATVASIVGIGAEVTIFLLPIAGISAGIPSLVNNELILHDKATSVVNYFNHLSESKKYGPLKTEDDKILVPIDDLVISEIDFNNNSIKLGTCNILAMEGGSGHTVTGNIDHFFSSPSISSHIPSLSIYSAIGIETENLDFSKKIMMLPNAPSRVFWWETGAVPGLRSLENDGTRLLDSIRDLYPGKFYWRFYAFFDYAITTLKPVYEDTNIKIKLDKDTRNFIMPTITTNEIRNKLSYSFDGAGGTYSLLLSSYPISTNINLSKDDLWIFNIDNEVREISIENGTIKKGKLIKDVLSKIDINKNKLIIGNQTIDFSGDIDNKDRYIFLTCELDDKISLIIEINLVAKSYSLLLSGDKNYLISNLSNTIEKINTLGLDSKNIAYNYTDESNNKYFGAISKTSQKSIIHYKKDSKNILEFYNDSTLEFNSKDFIAEDINVFMKDDINTITGKYYVDNNTDKSIDFSISLVSKNQVKVNGLYLNESVYSSYLDFVKNSDGHHNTSNFMNLFLDNISFWKLFGFENINFVIDKYFTLVGKTNLGYVEFICDNNKNIDIYFGEWKTSSSKSTIFSGNGRNVVVEPIYNPDTGEDISTSLDFSYEPLYGIDRYINKVLIAPDLYTSLININTNYYSNEYYPEIIVLNPNTFHKKVNINLDSSSFEYKWSTEGSDFILVRYLEESNKKILQKIRIKGILSNTQSFNKMSIDFKDIKKLSLGYIMSNFKSFNSENELDRDHLGFKIIDNKTYYYDEDSKLVKGLININNSLFYFDPIEFNLVTGWQTINGKKYYFDINTGAALTSYKIINGKHFYFNNDGVMQLGVFKGPDGFEYFAPANTQNNNIEGQAIVYQSKFLTLNGKKYYFDNNSKAVTGWRIINNEKYYFNPNNAIAAVGLQVIDNNKYYFNPDTAIISKGWQTVNGSRYYFDTDTAIAFNGYKTIDGKHFYFDSDCVVKIGVFSTSNGFEYFAPANTYNNNIEGQAIVYQSKFLTLNGKKYYFDNNSKAVTGLQTIDSKKYYFNTNTAEAATGWQTIDGKKYYFNTNTAEAATGWQTIDGKKYYFNTNTAIASTGYTIINGKHFYFNTDGIMQIGVFKGPNGFEYFAPANTDANNIEGQAILYQNEFLTLNGKKYYFGSDSKAVTGWRIINNKKYYFNPNNAIAAIHLCTINNDKYYFSYDGILQNGYITIERNNFYFDANNESKMVTGVFKGPNGFEYFAPANTHNNNIEGQAIVYQNKFLTLNGKKYYFDNDSKAVTGWQTIDGKKYYFNLNTAEAATGWQTIDGKKYYFNLNTAEAATGWQTIDGKKYYFNTNTFIASTGYTSINGKHFYFNTDGIMQIGVFKGPNGFEYFAPANTDANNIEGQAILYQNKFLTLNGKKYYFGSDSKAVTGLRTIDGKKYYFNTNTAVAVTGWQTINGKKYYFNTNTSIASTGYTIISGKHFYFNTDGIMQIGVFKGPDGFEYFAPANTDANNIEGQAIRYQNRFLYLHDNIYYFGNNSKAATGWVTIDGNRYYFEPNTAMGANGYKTIDNKNFYFRNGLPQIGVFKGSNGFEYFAPANTDANNIEGQAIRYQNRFLHLLGKIYYFGNNSKAVTGWQTINGKVYYFMPDTAMAAAGGLFEIDGVIYFFGVDGVKAPGIYG

SEQ ID NO: 11 - protein, 2710 aa, Artificial Sequence
  VPI 10463 strain, W101A, D287A, E514Q, S517A TcdA (Quad S517)
MSLISKEELIKLAYSIRPRENEYKTILTNLDEYNKLTTNNNENKYLQLKKLNESIDVFMNKYKTSSRNRALSNLKKDILKEVILIKNSNTSPVEKNLHFVAIGGEVSDIALEYIKQWADINAEYNIKLWYDSEAFLVNTLKKAIVESSTTEALQLLEEEIQNPQFDNMKFYKKRMEFIYDRQKRFINYYKSQINKPTVPTIDDIIKSHLVSEYNRDETVLESYRTNSLRKINSNHGIDIRANSLFTEQELLNIYSQELLNRGNLAAASDIVRLLALKNFGGVYLDVAMLPGIHSDLFKTISRPSSIGLDRWEMIKLEAIMKYKKYINNYTSENFDKLDQQLKDNFKLIIESKSEKSEIFSKLENLNVSDLEIKIAFALGSVINQALISKQGSYLTNLVIEQVKNRYQFLNQHLNPAIESDNNFTDTTKIFHDSLFNSATAENSMFLTKIAPYLQVGFMPEARSTISLSGPGAYASAYYDFINLQENTIEKTLKASDLIEFKFPENNLSQLTEQQINALWSFDQASAKYQFEKYVRDYTGGSLSEDNGVDFNKNTALDKNYLLNNKIPSNNVEEAGSKNYVHYIIQLQGDDISYEATCNLFSKNPKNSIIIQRNMNESAKSYFLSDDGESILELNKYRIPERLKNKEKVKVTFIGHGKDEFNTSEFARLSVDSLSNEISSFLDTIKLDISPKNVEVNLLGCNMFSYDFNVEETYPGKLLLSIMDKITSTLPDVNKNSITIGANQYEVRINSEGRKELLAHSGKWINKEEAIMSDLSSKEYIFFDSIDNKLKAKSKNIPGLASISEDIKTLLLDASVSPDTKFILNNLKLNIESSIGDYIYYEKLEPVKNIIHNSIDDLIDEFNLLENVSDELYELKKLNNLDEKYLISFEDISKNNSTYSVRFINKSNGESVYVETEKEIFSKYSEHITKEISTIKNSIITDVNGNLLDNIQLDHTSQVNTLNAAFFIQSLIDYSSNKDVLNDLSTSVKVQLYAQLFSTGLNTIYDSIQLVNLISNAVNDTINVLPTITEGIPIVSTILDGINLGAAIKELLDEHDPLLKKELEAKVGVLAINMSLSIAATVASIVGIGAEVTIFLLPIAGISAGIPSLVNNELILHDKATSVVNYFNHLSESKKYGPLKTEDDKILVPIDDLVISEIDFNNNSIKLGTCNILAMEGGSGHTVTGNIDHFFSSPSISSHIPSLSIYSAIGIETENLDFSKKIMMLPNAPSRVFWWETGAVPGLRSLENDGTRLLDSIRDLYPGKFYWRFYAFFDYAITTLKPVYEDTNIKIKLDKDTRNFIMPTITTNEIRNKLSYSFDGAGGTYSLLLSSYPISTNINLSKDDLWIFNIDNEVREISIENGTIKKGKLIKDVLSKIDINKNKLIIGNQTIDFSGDIDNKDRYIFLTCELDDKISLIIEINLVAKSYSLLLSGDKNYLISNLSNTIEKINTLGLDSKNIAYNYTDESNNKYFGAISKTSQKSIIHYKKDSKNILEFYNDSTLEFNSKDFIAEDINVFMKDDINTITGKYYVDNNTDKSIDFSISLVSKNQVKVNGLYLNESVYSSYLDFVKNSDGHHNTSNFMNLFLDNISFWKLFGFENINFVIDKYFTLVGKTNLGYVEFICDNNKNIDIYFGEWKTSSSKSTIFSGNGRNVVVEPIYNPDTGEDISTSLDFSYEPLYGIDRYINKVLIAPDLYTSLININTNYYSNEYYPEIIVLNPNTFHKKVNINLDSSSFEYKWSTEGSDFILVRYLEESNKKILQKIRIKGILSNTQSFNKMSIDFKDIKKLSLGYIMSNFKSFNSENELDRDHLGFKIIDNKTYYYDEDSKLVKGLININNSLFYFDPIEFNLVTGWQTINGKKYYFDINTGAALTSYKIINGKHFYFNNDGVMQLGVFKGPDGFEYFAPANTQNNNIEGQAIVYQSKFLTLNGKKYYFDNNSKAVTGWRIINNEKYYFNPNNAIAAVGLQVIDNNKYYFNPDTAIISKGWQTVNGSRYYFDTDTAIAFNGYKTIDGKHFYFDSDCVVKIGVFSTSNGFEYFAPANTYNNNIEGQAIVYQSKFLTLNGKKYYFDNNSKAVTGLQTIDSKKYYFNTNTAEAATGWQTIDGKKYYFNTNTAEAATGWQTIDGKKYYFNTNTAIASTGYTIINGKHFYFNTDGIMQIGVFKGPNGFEYFAPANTDANNIEGQAILYQNEFLTLNGKKYYFGSDSKAVTGWRIINNKKYYFNPNNAIAAIHLCTINNDKYYFSYDGILQNGYITIERNNFYFDANNESKMVTGVFKGPNGFEYFAPANTHNNNIEGQAIVYQNKFLTLNGKKYYFDNDSKAVTGWQTIDGKKYYFNLNTAEAATGWQTIDGKKYYFNLNTAEAATGWQTIDGKKYYFNTNTFIASTGYTSINGKHFYFNTDGIMQIGVFKGPNGFEYFAPANTDANNIEGQAILYQNKFLTLNGKKYYFGSDSKAVTGLRTIDGKKYYFNTNTAVAVTGWQTINGKKYYFNTNTSIASTGYTIISGKHFYFNTDGIMQIGVFKGPDGFEYFAPANTDANNIEGQAIRYQNRFLYLHDNIYYFGNNSKAATGWVTIDGNRYYFEPNTAMGANGYKTIDNKNFYFRNGLPQIGVFKGSNGFEYFAPANTDANNIEGQAIRYQNRFLHLLGKIYYFGNNSKAVTGWQTINGKVYYFMPDTAMAAAGGLFEIDGVIYFFGVDGVKAPGIYG

SEQ ID NO: 12 - protein, 2710 aa, Artificial Sequence
  VPI 10463 strain, W101A, D287A, E514Q, W519A TcdA (Quad S519)
MSLISKEELIKLAYSIRPRENEYKTILTNLDEYNKLTTNNNENKYLQLKKLNESIDVFMNKYKTSSRNRALSNLKKDILKEVILIKNSNTSPVEKNLHFVAIGGEVSDIALEYIKQWADINAEYNIKLWYDSEAFLVNTLKKAIVESSTTEALQLLEEEIQNPQFDNMKFYKKRMEFIYDRQKRFINYYKSQINKPTVPTIDDIIKSHLVSEYNRDETVLESYRTNSLRKINSNHGIDIRANSLFTEQELLNIYSQELLNRGNLAAASDIVRLLALKNFGGVYLDVAMLPGIHSDLFKTISRPSSIGLDRWEMIKLEAIMKYKKYINNYTSENFDKLDQQLKDNFKLIIESKSEKSEIFSKLENLNVSDLEIKIAFALGSVINQALISKQGSYLTNLVIEQVKNRYQFLNQHLNPAIESDNNFTDTTKIFHDSLFNSATAENSMFLTKIAPYLQVGFMPEARSTISLSGPGAYASAYYDFINLQENTIEKTLKASDLIEFKFPENNLSQLTEQQINSLASFDQASAKYQFEKYVRDYTGGSLSEDNGVDFNKNTALDKNYLLNNKIPSNNVEEAGSKNYVHYIIQLQGDDISYEATCNLFSKNPKNSIIIQRNMNESAKSYFLSDDGESILELNKYRIPERLKNKEKVKVTFIGHGKDEFNTSEFARLSVDSLSNEISSFLDTIKLDISPKNVEVNLLGCNMFSYDFNVEETYPGKLLLSIMDKITSTLPDVNKNSITIGANQYEVRINSEGRKELLAHSGKWINKEEAIMSDLSSKEYIFFDSIDNKLKAKSKNIPGLASISEDIKTLLLDASVSPDTKFILNNLKLNIESSIGDYIYYEKLEPVKNIIHNSIDDLIDEFNLLENVSDELYELKKLNNLDEKYLISFEDISKNNSTYSVRFINKSNGESVYVETEKEIFSKYSEHITKEISTIKNSIITDVNGNLLDNIQLDHTSQVNTLNAAFFIQSLIDYSSNKDVLNDLSTSVKVQLYAQLFSTGLNTIYDSIQLVNLISNAVNDTINVLPTITEGIPIVSTILDGINLGAAIKELLDEHDPLLKKELEAKVGVLAINMSLSIAATVASIVGIGAEVTIFLLPIAGISAGIPSLVNNELILHDKATSVVNYFNHLSESKKYGPLKTEDDKILVPIDDLVISEIDFNNNSIKLGTCNILAMEGGSGHTVTGNIDHFFSSPSISSHIPSLSIYSAIGIETENLDFSKKIMMLPNAPSRVFWWETGAVPGLRSLENDGTRLLDSIRDLYPGKFYWRFYAFFDYAITTLKPVYEDTNIKIKLDKDTRNFIMPTITTNEIRNKLSYSFDGAGGTYSLLLSSYPISTNINLSKDDLWIFNIDNEVREISIENGTIKKGKLIKDVLSKIDINKNKLIIGNQTIDFSGDIDNKDRYIFLTCELDDKISLIIEINLVAKSYSLLLSGDKNYLISNLSNTIEKINTLGLDSKNIAYNYTDESNNKYFGAISKTSQKSIIHYKKDSKNILEFYNDSTLEFNSKDFIAEDINVFMKDDINTITGKYYVDNNTDKSIDFSISLVSKNQVKVNGLYLNESVYSSYLDFVKNSDGHHNTSNFMNLFLDNISFWKLFGFENINFVIDKYFTLVGKTNLGYVEFICDNNKNIDIYFGEWKTSSSKSTIFSGNGRNVVVEPIYNPDTGEDISTSLDFSYEPLYGIDRYINKVLIAPDLYTSLININTNYYSNEYYPEIIVLNPNTFHKKVNINLDSSSFEYKWSTEGSDFILVRYLEESNKKILQKIRIKGILSNTQSFNKMSIDFKDIKKLSLGYIMSNFKSFNSENELDRDHLGFKIIDNKTYYYDEDSKLVKGLININNSLFYFDPIEFNLVTGWQTINGKKYYFDINTGAALTSYKIINGKHFYFNNDGVMQLGVFKGPDGFEYFAPANTQNNNIEGQAIVYQSKFLTLNGKKYYFDNNSKAVTGWRIINNEKYYFNPNNAIAAVGLQVIDNNKYYFNPDTAIISKGWQTVNGSRYYFDTDTAIAFNGYKTIDGKHFYFDSDCVVKIGVFSTSNGFEYFAPANTYNNNIEGQAIVYQSKFLTLNGKKYYFDNNSKAVTGLQTIDSKKYYFNTNTAEAATGWQTIDGKKYYFNTNTAEAATGWQTIDGKKYYFNTNTAIASTGYTIINGKHFYFNTDGIMQIGVFKGPNGFEYFAPANTDANNIEGQAILYQNEFLTLNGKKYYFGSDSKAVTGWRIINNKKYYFNPNNAIAAIHLCTINNDKYYFSYDGILQNGYITIERNNFYFDANNESKMVTGVFKGPNGFEYFAPANTHNNNIEGQAIVYQNKFLTLNGKKYYFDNDSKAVTGWQTIDGKKYYFNLNTAEAATGWQTIDGKKYYFNLNTAEAATGWQTIDGKKYYFNTNTFIASTGYTSINGKHFYFNTDGIMQIGVFKGPNGFEYFAPANTDANNIEGQAILYQNKFLTLNGKKYYFGSDSKAVTGLRTIDGKKYYFNTNTAVAVTGWQTINGKKYYFNTNTSIASTGYTIISGKHFYFNTDGIMQIGVFKGPDGFEYFAPANTDANNIEGQAIRYQNRFLYLHDNIYYFGNNSKAATGWVTIDGNRYYFEPNTAMGANGYKTIDNKNFYFRNGLPQIGVFKGSNGFEYFAPANTDANNIEGQAIRYQNRFLHLLGKIYYFGNNSKAVTGWQTINGKVYYFMPDTAMAAAGGLFEIDGVIYFFGVDGVKAPGIYG

SEQ ID NO: 13 - DNA, 7128 bp, Artificial Sequence
  VPI 10463 strain, W102A, D288A, E515Q TcdB (Tri)
atgggaagtttagttaatagaaaacagttagaaaaaatggcaaatgtaagatttcgtactcaagaagatgaatatgttgcaatattggatgctttagaagaatatcataatatgtcagagaatactgtagtcgaaaaatatttaaaattaaaagatataaatagtttaacagatatttatatagatacatataaaaaatctggtagaaataaagccttaaaaaaatttaaggaatatctagttacagaagtattagagctaaagaataataatttaactccagttgagaaaaatttacattttgttgcgattggaggtcaaataaatgacactgctattaattatataaatcaatggaaagatgtaaatagtgattataatgttaatgttttttatgatagtaatgcatttttgataaacacattgaaaaaaactgtagtagaatcagcaataaatgatacacttgaatcatttagagaaaacttaaatgaccctagatttgactataataaattcttcagaaaacgtatggaaataatttatgataaacagaaaaatttcataaactactataaagctcaaagagaagaaaatcctgaacttataattgatgatattgtaaagacatatctttcaaatgagtattcaaaggagatagatgaacttaatacctatattgaagaatccttaaataaaattacacagaatagtggaaatgatgttagaaactttgaagaatttaaaaatggagagtcattcaacttatatgaacaagagttggtagaaaggtggaatttagctgctgcttctgacatattaagaatatctgcattaaaagaaattggtggtatgtatttagatgttgctatgttaccaggaatacaaccagacttatttgagtctatagagaaacctagttcagtaacagtggatttttgggaaatgacaaagttagaagctataatgaaatacaaagaatatataccagaatatacctcagaacattttgacatgttagacgaagaagttcaaagtagttttgaatctgttctagcttctaagtcagataaatcagaaatattctcatcacttggtgatatggaggcatcaccactagaagttaaaattgcatttaatagtaagggtattataaatcaagggctaatttctgtgaaagactcatattgtagcaatttaatagtaaaacaaatcgagaatagatataaaatattgaataatagtttaaatccagctattagcgaggataatgattttaatactacaacgaatacctttattgatagtataatggctgaagctaatgcagataatggtagatttatgatggaactaggaaagtatttaagagttggtttcttcccagatgttaaaactactattaacttaagtggccctgaagcatatgcggcagcttatcaagatttattaatgtttaaagaaggcagtatgaatatccatttgatagaagctgatttaagaaactttgaaatctctaaaactaatatttctcaatcaactgaacaacaaatggctagcttatggtcatttgacgatgcaagagctaaagctcaatttgaagaatataaaaggaattattttgaaggttctcttggtgaagatgataatcttgatttttctcaaaatatagtagttgacaaggagtatcttttagaaaaaatatcttcattagcaagaagttcagagagaggatatatacactatattgttcagttacaaggagataaaattagttatgaagcagcatgtaacttatttgcaaagactccttatgatagtgtactgtttcagaaaaatatagaagattcagaaattgcatattattataatcctggagatggtgaaatacaagaaatagacaagtataaaattccaagtataatttctgatagacctaagattaaattaacatttattggtcatggtaaagatgaatttaatactgatatatttgcaggttttgatgtagattcattatccacagaaatagaagcagcaatagatttagctaaagaggatatttctcctaagtcaatagaaataaatttattaggatgtaatatgtttagctactctatcaacgtagaggagacttatcctggaaaattattacttaaagttaaagataaaatatcagaattaatgccatctataagtcaagactctattatagtaagtgcaaatcaatatgaagttagaataaatagtgaaggaagaagagaattattggatcattctggtgaatggataaataaagaagaaagtattataaaggatatttcatcaaaagaatatatatcatttaatcctaaagaaaataaaattacagtaaaatctaaaaatttacctgagctatctacattattacaagaaattagaaataattctaattcaagtgatattgaactagaagaaaaagtaatgttaacagaatgtgagataaatgttatttcaaatatagatacgcaaattgttgaggaaaggattgaagaagctaagaatttaacttctgactctattaattatataaaagatgaatttaaactaatagaatctatttctgatgcactatgtgacttaaaacaacagaatgaattagaagattctcattttatatcttttgaggacatatcagagactgatgagggatttagtataagatttattaataaagaaactggagaatctatatttgtagaaactgaaaaaacaatattctctgaatatgctaatcatataactgaagagatttctaagataaaaggtactatatttgatactgtaaatggtaagttagtaaaaaaagtaaatttagatactacacacgaagtaaatactttaaatgctgcattttttatacaatcattaatagaatataatagttctaaagaatctcttagtaatttaagtgtagcaatgaaagtccaagtttacgctcaattatttagtactggtttaaatactattacagatgcagccaaagttgttgaattagtatcaactgcattagatgaaactatagacttacttcctacattatctgaaggattacctataattgcaactattatagatggtgtaagtttaggtgcagcaatcaaagagctaagtgaaacgagtgacccattattaagacaagaaatagaagctaagataggtataatggcagtaaatttaacaacagctacaactgcaatcattacttcatctttggggatagctagtggatttagtatacttttagttcctttagcaggaatttcagcaggtataccaagcttagtaaacaatgaacttgtacttcgagataaggcaacaaaggttgtagattattttaaacatgtttcattagttgaaactgaaggagtatttactttattagatgataaaataatgatgccacaagatgatttagtgatatcagaaatagattttaataataattcaatagttttaggtaaatgtgaaatctggagaatggaaggtggttcaggtcatactgtaactgatgatatagatcacttcttttcagcaccatcaataacatatagagagccacacttatctatatatgacgtattggaagtacaaaaagaagaacttgatttgtcaaaagatttaatggtattacctaatgctccaaatagagtatttgcttgggaaacaggatggacaccaggtttaagaagcttagaaaatgatggcacaaaactgttagaccgtataagagataactatgaaggtgagttttattggagatattttgcttttatagctgatgctttaataacaacattaaaaccaagatatgaagatactaatataagaataaatttagatagtaatactagaagttttatagttccaataataactacagaatatataagagaaaaattatcatattctttctatggttcaggaggaacttatgcattgtctctttctcaatataatatgggtataaatatagaattaagtgaaagtgatgtttggattatagatgttgataatgttgtgagagatgtaactatagaatctgataaaattaaaaaaggtgatttaatagaaggtattttatctacactaagtattgaagagaataaaattatcttaaatagccatgagattaatttttctggtgaggtaaatggaagtaatggatttgtttctttaacattttcaattttagaaggaataaatgcaattatagaagttgatttattatctaaatcatataaattacttatttctggcgaattaaaaatattgatgttaaattcaaatcatattcaacagaaaatagattatataggattcaatagcgaattacagaaaaatataccatatagctttgtagatagtgaaggaaaagagaatggttttattaatggttcaacaaaagaaggtttatttgtatctgaattacctgatgtagttcttataagtaaggtttatatggatgatagtaagccttcatttggatattatagtaataatttgaaagatgtcaaagttataactaaagataatgttaatatattaacaggttattatcttaaggatgatataaaaatctctctttctttgactctacaagatgaaaaaactataaagttaaatagtgtgcatttagatgaaagtggagtagctgagattttgaagttcatgaatagaaaaggtaatacaaatacttcagattctttaatgagctttttagaaagtatgaatataaaaagtattttcgttaatttcttacaatctaatattaagtttatattagatgctaattttataataagtggtactacttctattggccaatttgagtttatttgtgatgaaaatgataatatacaaccatatttcattaagtttaatacactagaaactaattatactttatatgtaggaaatagacaaaatatgatagtggaaccaaattatgatttagatgattctggagatatatcttcaactgttatcaatttctctcaaaagtatctttatggaatagacagttgtgttaataaagttgtaatttcaccaaatatttatacagatgaaataaatataacgcctgtatatgaaacaaataatacttatccagaagttattgtattagatgcaaattatataaatgaaaaaataaatgttaatatcaatgatctatctatacgatatgtatggagtaatgatggtaatgattttattcttatgtcaactagtgaagaaaataaggtgtcacaagttaaaataagattcgttaatgtttttaaagataagactttggcaaataagctatcttttaactttagtgataaacaagatgtacctgtaagtgaaataatcttatcatttacaccttcatattatgaggatggattgattggctatgatttgggtctagtttctttatataatgagaaattttatattaataactttggaatgatggtatctggattaatatatattaatgattcattatattattttaaaccaccagtaaataatttgataactggatttgtgactgtaggcgatgataaatactactttaatccaattaatggtggagctgcttcaattggagagacaataattgatgacaaaaattattatttcaaccaaagtggagtgttacaaacaggtgtatttagtacagaagatggatttaaatattttgccccagctaatacacttgatgaaaacctagaaggagaagcaattgattttactggaaaattaattattgacgaaaatatttattattttgatgataattatagaggagctgtagaatggaaagaattagatggtgaaatgcactattttagcccagaaacaggtaaagcttttaaaggtctaaatcaaataggtgattataaatactatttcaattctgatggagttatgcaaaaaggatttgttagtataaatgataataaacactattttgatgattctggtgttatgaaagtaggttacactgaaatagatggcaagcatttctactttgctgaaaacggagaaatgcaaataggagtatttaatacagaagatggatttaaatattttgctcatcataatgaagatttaggaaatgaagaaggtgaagaaatctcatattctggtatattaaatttcaataataaaatttactattttgatgattcatttacagctgtagttggatggaaagatttagaggatggttcaaagtattattttgatgaagatacagcagaagcatatataggtttgtcattaataaatgatggtcaatattattttaatgatgatggaattatgcaagttggatttgtcactataaatgataaagtcttctacttctctgactctggaattatagaatctggagtacaaaacatagatgacaattatttctatatagatgataatggtatagttcaaattggtgtatttgatacttcagatggatataaatattttgcacctgctaatactgtaaatgataatatttacggacaagcagttgaatatagtggtttagttagagttggggaagatgtatattattttggagaaacatatacaattgagactggatggatatatgatatggaaaatgaaagtgataaatattatttcaatccagaaactaaaaaagcatgcaaaggtattaatttaattgatgatataaaatattattttgatgagaagggcataatgagaacgggtcttatatcatttgaaaataataattattactttaatgagaatggtgaaatgcaatttggttatataaatatagaagataagatgttctattttggtgaagatggtgtcatgcagattggagtatttaatacaccagatggatttaaatactttgcacatcaaaatactttggatgagaattttgagggagaatcaataaactatactggttggttagatttagatgaaaagagatattattttacagatgaatatattgcagcaactggttcagttattattgatggtgaggagtattattttgatcctgatacagctcaattagtgattagtgaactcgagcaccaccaccaccaccactga

SEQ ID NO: 14 - DNA, 7125 bp, Artificial Sequence
  VPI 10463 strain, TcdB (W102Del)
atgggaagtttagttaatagaaaacagttagaaaaaatggcaaatgtaagatttcgtactcaagaagatgaatatgttgcaatattggatgctttagaagaatatcataatatgtcagagaatactgtagtcgaaaaatatttaaaattaaaagatataaatagtttaacagatatttatatagatacatataaaaaatctggtagaaataaagccttaaaaaaatttaaggaatatctagttacagaagtattagagctaaagaataataatttaactccagttgagaaaaatttacattttgttattggaggtcaaataaatgacactgctattaattatataaatcaatggaaagatgtaaatagtgattataatgttaatgttttttatgatagtaatgcatttttgataaacacattgaaaaaaactgtagtagaatcagcaataaatgatacacttgaatcatttagagaaaacttaaatgaccctagatttgactataataaattcttcagaaaacgtatggaaataatttatgataaacagaaaaatttcataaactactataaagctcaaagagaagaaaatcctgaacttataattgatgatattgtaaagacatatctttcaaatgagtattcaaaggagatagatgaacttaatacctatattgaagaatccttaaataaaattacacagaatagtggaaatgatgttagaaactttgaagaatttaaaaatggagagtcattcaacttatatgaacaagagttggtagaaaggtggaatttagctgctgcttctgacatattaagaatatctgcattaaaagaaattggtggtatgtatttagatgttgatatgttaccaggaatacaaccagacttatttgagtctatagagaaacctagttcagtaacagtggatttttgggaaatgacaaagttagaagctataatgaaatacaaagaatatataccagaatatacctcagaacattttgacatgttagacgaagaagttcaaagtagttttgaatctgttctagcttctaagtcagataaatcagaaatattctcatcacttggtgatatggaggcatcaccactagaagttaaaattgcatttaatagtaagggtattataaatcaagggctaatttctgtgaaagactcatattgtagcaatttaatagtaaaacaaatcgagaatagatataaaatattgaataatagtttaaatccagctattagcgaggataatgattttaatactacaacgaatacctttattgatagtataatggctgaagctaatgcagataatggtagatttatgatggaactaggaaagtatttaagagttggtttcttcccagatgttaaaactactattaacttaagtggccctgaagcatatgcggcagcttatcaagatttattaatgtttaaagaaggcagtatgaatatccatttgatagaagctgatttaagaaactttgaaatctctaaaactaatatttctcaatcaactgaacaagaaatggctagcttatggtcatttgacgatgcaagagctaaagctcaatttgaagaatataaaaggaattattttgaaggttctcttggtgaagatgataatcttgatttttctcaaaatatagtagttgacaaggagtatcttttagaaaaaatatcttcattagcaagaagttcagagagaggatatatacactatattgttcagttacaaggagataaaattagttatgaagcagcatgtaacttatttgcaaagactccttatgatagtgtactgtttcagaaaaatatagaagattcagaaattgcatattattataatcctggagatggtgaaatacaagaaatagacaagtataaaattccaagtataatttctgatagacctaagattaaattaacatttattggtcatggtaaagatgaatttaatactgatatatttgcaggttttgatgtagattcattatccacagaaatagaagcagcaatagatttagctaaagaggatatttctcctaagtcaatagaaataaatttattaggatgtaatatgtttagctactctatcaacgtagaggagacttatcctggaaaattattacttaaagttaaagataaaatatcagaattaatgccatctataagtcaagactctattatagtaagtgcaaatcaatatgaagttagaataaatagtgaaggaagaagagaattattggatcattctggtgaatggataaataaagaagaaagtattataaaggatatttcatcaaaagaatatatatcatttaatcctaaagaaaataaaattacagtaaaatctaaaaatttacctgagctatctacattattacaagaaattagaaataattctaattcaagtgatattgaactagaagaaaaagtaatgttaacagaatgtgagataaatgttatttcaaatatagatacgcaaattgttgaggaaaggattgaagaagctaagaatttaacttctgactctattaattatataaaagatgaatttaaactaatagaatctatttctgatgcactatgtgacttaaaacaacagaatgaattagaagattctcattttatatcttttgaggacatatcagagactgatgagggatttagtataagatttattaataaagaaactggagaatctatatttgtagaaactgaaaaaacaatattctctgaatatgctaatcatataactgaagagatttctaagataaaaggtactatatttgatactgtaaatggtaagttagtaaaaaaagtaaatttagatactacacacgaagtaaatactttaaatgctgcattttttatacaatcattaatagaatataatagttctaaagaatctcttagtaatttaagtgtagcaatgaaagtccaagtttacgctcaattatttagtactggtttaaatactattacagatgcagccaaagttgttgaattagtatcaactgcattagatgaaactatagacttacttcctacattatctgaaggattacctataattgcaactattatagatggtgtaagtttaggtgcagcaatcaaagagctaagtgaaacgagtgacccattattaagacaagaaatagaagctaagataggtataatggcagtaaatttaacaacagctacaactgcaatcattacttcatctttggggatagctagtggatttagtatacttttagttcctttagcaggaatttcagcaggtataccaagcttagtaaacaatgaacttgtacttcgagataaggcaacaaaggttgtagattattttaaacatgtttcattagttgaaactgaaggagtatttactttattagatgataaaataatgatgccacaagatgatttagtgatatcagaaatagattttaataataattcaatagttttaggtaaatgtgaaatctggagaatggaaggtggttcaggtcatactgtaactgatgatatagatcacttcttttcagcaccatcaataacatatagagagccacacttatctatatatgacgtattggaagtacaaaaagaagaacttgatttgtcaaaagatttaatggtattacctaatgctccaaatagagtatttgcttgggaaacaggatggacaccaggtttaagaagcttagaaaatgatggcacaaaactgttagaccgtataagagataactatgaaggtgagttttattggagatattttgcttttatagctgatgctttaataacaacattaaaaccaagatatgaagatactaatataagaataaatttagatagtaatactagaagttttatagttccaataataactacagaatatataagagaaaaattatcatattctttctatggttcaggaggaacttatgcattgtctctttctcaatataatatgggtataaatatagaattaagtgaaagtgatgtttggattatagatgttgataatgttgtgagagatgtaactatagaatctgataaaattaaaaaaggtgatttaatagaaggtattttatctacactaagtattgaagagaataaaattatcttaaatagccatgagattaatttttctggtgaggtaaatggaagtaatggatttgtttctttaacattttcaattttagaaggaataaatgcaattatagaagttgatttattatctaaatcatataaattacttatttctggcgaattaaaaatattgatgttaaattcaaatcatattcaacagaaaatagattatataggattcaatagcgaattacagaaaaatataccatatagctttgtagatagtgaaggaaaagagaatggttttattaatggttcaacaaaagaaggtttatttgtatctgaattacctgatgtagttcttataagtaaggtttatatggatgatagtaagccttcatttggatattatagtaataatttgaaagatgtcaaagttataactaaagataatgttaatatattaacaggttattatcttaaggatgatataaaaatctctctttctttgactctacaagatgaaaaaactataaagttaaatagtgtgcatttagatgaaagtggagtagctgagattttgaagttcatgaatagaaaaggtaatacaaatacttcagattctttaatgagctttttagaaagtatgaatataaaaagtattttcgttaatttcttacaatctaatattaagtttatattagatgctaattttataataagtggtactacttctattggccaatttgagtttatttgtgatgaaaatgataatatacaaccatatttcattaagtttaatacactagaaactaattatactttatatgtaggaaatagacaaaatatgatagtggaaccaaattatgatttagatgattctggagatatatcttcaactgttatcaatttctctcaaaagtatctttatggaatagacagttgtgttaataaagttgtaatttcaccaaatatttatacagatgaaataaatataacgcctgtatatgaaacaaataatacttatccagaagttattgtattagatgcaaattatataaatgaaaaaataaatgttaatatcaatgatctatctatacgatatgtatggagtaatgatggtaatgattttattcttatgtcaactagtgaagaaaataaggtgtcacaagttaaaataagattcgttaatgtttttaaagataagactttggcaaataagctatcttttaactttagtgataaacaagatgtacctgtaagtgaaataatcttatcatttacaccttcatattatgaggatggattgattggctatgatttgggtctagtttctttatataatgagaaattttatattaataactttggaatgatggtatctggattaatatatattaatgattcattatattattttaaaccaccagtaaataatttgataactggatttgtgactgtaggcgatgataaatactactttaatccaattaatggtggagctgcttcaattggagagacaataattgatgacaaaaattattatttcaaccaaagtggagtgttacaaacaggtgtatttagtacagaagatggatttaaatattttgccccagctaatacacttgatgaaaacctagaaggagaagcaattgattttactggaaaattaattattgacgaaaatatttattattttgatgataattatagaggagctgtagaatggaaagaattagatggtgaaatgcactattttagcccagaaacaggtaaagcttttaaaggtctaaatcaaataggtgattataaatactatttcaattctgatggagttatgcaaaaaggatttgttagtataaatgataataaacactattttgatgattctggtgttatgaaagtaggttacactgaaatagatggcaagcatttctactttgctgaaaacggagaaatgcaaataggagtatttaatacagaagatggatttaaatattttgctcatcataatgaagatttaggaaatgaagaaggtgaagaaatctcatattctggtatattaaatttcaataataaaatttactattttgatgattcatttacagctgtagttggatggaaagatttagaggatggttcaaagtattattttgatgaagatacagcagaagcatatataggtttgtcattaataaatgatggtcaatattattttaatgatgatggaattatgcaagttggatttgtcactataaatgataaagtcttctacttctctgactctggaattatagaatctggagtacaaaacatagatgacaattatttctatatagatgataatggtatagttcaaattggtgtatttgatacttcagatggatataaatattttgcacctgctaatactgtaaatgataatatttacggacaagcagttgaatatagtggtttagttagagttggggaagatgtatattattttggagaaacatatacaattgagactggatggatatatgatatggaaaatgaaagtgataaatattatttcaatccagaaactaaaaaagcatgcaaaggtattaatttaattgatgatataaaatattattttgatgagaagggcataatgagaacgggtcttatatcatttgaaaataataattattactttaatgagaatggtgaaatgcaatttggttatataaatatagaagataagatgttctattttggtgaagatggtgtcatgcagattggagtatttaatacaccagatggatttaaatactttgcacatcaaaatactttggatgagaattttgagggagaatcaataaactatactggttggttagatttagatgaaaagagatattattttacagatgaatatattgcagcaactggttcagttattattgatggtgaggagtattattttgatcctgatacagctcaattagtgattagtgaactcgagcaccaccaccaccaccactga

SEQ ID NO: 15 - DNA, 7125 bp, Artificial Sequence
  VPI 10463 strain, E. coli optimized W102A, D288A, E515Q TcdB (Tri)
atgtccctggtgaatcgcaaacagctggaaaagatggctaacgttcgttttcgcacccaggaggatgagtacgtggctattctggatgcgctggaggagtaccataatatgtctgaaaataccgttgtcgagaaatatttgaaactgaaggacattaactcgttgaccgacatctacattgacacctacaagaaaagcggtcgtaacaaagcgttgaagaagttcaaggagtatctggttacggaggtgctggaactgaagaataataacttgaccccggtggaaaagaatctgcatttcgtcgccattggtggtcaaatcaacgataccgcgattaactatatcaaccaatggaaggacgtcaacagcgattacaatgttaatgtgttttatgatagcaatgcattcttgattaacacgctgaaaaagaccgtggttgagtcggccattaacgacaccctggagagctttcgcgagaacctgaacgacccgcgtttcgactacaacaagtttttccgtaaacgcatggagattatctacgacaagcagaagaatttcattaactattacaaggcgcagcgtgaggaaaatccggaactgatcattgacgacattgtgaaaacttacctgagcaacgaatactccaaagaaatcgatgagttgaacacctatattgaggagagcctgaacaagattacccaaaattctggcaatgatgttcgtaacttcgaggaatttaagaatggtgagtccttcaacctgtatgaacaagaactggtggagcgttggaacctggcagccgcgtccgacatcctgcgcattagcgcgctgaaggaaattggtggcatgtatctggatgttgctatgctgccgggcattcagccggatttgtttgaatcgattgagaaaccgtcgagcgtgaccgttgacttttgggagatgaccaaattggaggcgattatgaagtacaaagagtatattccggagtataccagcgaacactttgacatgttggacgaagaggttcaatcgagcttcgagtccgttttggcctcgaaaagcgacaaatcggagattttctcgtcgctgggcgacatggaggcgagcccgctggaagtgaagatcgccttcaattcgaagggtatcattaatcaaggtctgatctccgtgaaagactcctactgtagcaacttgatcgtcaagcaaattgaaaaccgctacaagattctgaataactccctgaatccggcgatttctgaagataatgacttcaacaccaccacgaatacgttcatcgacagcatcatggctgaggcgaacgcagacaatggccgtttcatgatggaactgggcaaatatctgcgtgtgggtttctttccggacgttaaaacgacgattaacctgtccggtccggaggcttacgccgcagcctatcaagatctgctgatgttcaaagaaggctccatgaatatccacctgatcgaagctgacctgcgtaattttgagatctcgaagaccaacattagccagtcgacggaacaacaaatggcgagcttgtggtcttttgatgatgcgcgcgctaaagcccaattcgaggagtacaagcgtaactatttcgagggtagcctgggcgaagatgacaacctggacttcagccagaatatcgtcgtggataaggagtacctgctggagaagatttccagcctggctcgtagcagcgagcgcggttacattcattacatcgtccagctgcaaggtgataagatttcgtatgaggcggcgtgtaatctgtttgcaaaaaccccgtacgacagcgttctgtttcaaaagaacattgaggacagcgagattgcatattactacaacccgggtgacggtgaaatccaggagattgataagtacaagattccaagcatcattagcgatcgcccaaagattaaattgaccttcatcggccacggcaaggatgagttcaatacggacatcttcgcgggctttgacgtggactctctgagcacggagattgaggcagcgattgacctggcgaaggaggatatttctccaaagtccatcgaaattaacttgttgggttgtaatatgttcagctactctatcaacgtcgaggagacctatccgggtaagctgctgctgaaggttaaagacaagatttcggagttgatgccgagcatttcgcaggacagcattattgtgtccgctaaccagtatgaagttcgcatcaattccgagggccgccgcgaactgttggaccatagcggtgagtggattaacaaagaggagtctatcatcaaagatatctcctcgaaagaatacatttcttttaacccgaaagagaataaaatcaccgttaagtccaaaaatctgccagagctgagcaccctgttgcaggaaatccgtaacaacagcaattcttcggatatcgaactggaagaaaaggttatgctgaccgagtgcgagattaacgtcattagcaatatcgatacgcagattgtcgaggagcgtattgaagaagcgaagaacctgacgagcgactccatcaattacattaaggacgagtttaagttgattgagagcatttccgacgcgctgtgcgatttgaaacaacagaacgagctggaagattcccacttcatctcgtttgaggatatcagcgaaactgacgaaggtttttccatccgcttcatcaataaggagactggtgaaagcatcttcgttgaaaccgaaaagaccatcttctccgaatatgcgaaccacattaccgaggagatttccaaaatcaaaggtactatttttgacaccgtcaacggtaagttggtgaaaaaggttaatctggataccacgcatgaagtgaataccttgaacgctgcattcttcattcagtctctgattgagtacaatagctccaaggaatccctgtccaatctgagcgtggcgatgaaagttcaagtgtatgcgcaactgttttctactggtttgaacacgattaccgatgcggcaaaagtggtcgagctggttagcaccgcgctggacgagacgatcgatttgctgccgaccctgagcgagggtctgccaatcatcgctacgatcatcgatggtgtgagcttgggtgcggcgattaaggaactgtctgaaaccagcgatccgctgctgcgccaggaaattgaggccaagatcggcattatggcggtcaatctgaccaccgcgaccaccgcaattattacgagctccctgggtattgcgtctggcttcagcatcctgctggtgccgctggcgggtatttctgcaggcattccaagcttggtgaataatgagttggtgctgcgtgacaaagcaaccaaagttgttgattacttcaagcatgtttccttggtggaaactgaaggtgtgttcacgctgctggacgataaaattatgatgcctcaggatgacctggtgattagcgaaatcgactttaacaacaacagcattgtgttgggtaagtgtgagatctggcgcatggaaggtggttccggccacaccgttaccgacgacattgaccacttcttctcggcgccgtctattacttaccgtgagccgcacctgtcgatttatgatgttctggaggtgcagaaagaagagctggacctgtcgaaggatttgatggttctgccgaacgcccctaatcgcgttttcgcgtgggagactggttggaccccgggtctgcgttcgctggagaatgacggtaccaagctgttggaccgtatccgtgacaattatgagggtgagttttactggcgttattttgcctttatcgccgatgcgctgatcaccaccctgaaaccgcgctatgaagacactaacattcgcatcaacttggacagcaatacccgttcgtttatcgtgccgatcattaccaccgagtatatccgtgagaaactgtcctactcgttctacggttccggcggcacgtacgctctgtctctgagccagtacaacatgggcattaatatcgagctgtccgagtccgatgtgtggattattgacgttgacaacgtcgtccgcgacgttaccatcgagagcgataaaatcaaaaagggtgatctgattgagggtattctgtctaccttgtccatcgaggagaataagattattctgaatagccatgagatcaacttctcgggtgaggtgaatggttccaatggttttgtttctctgaccttctccattctggagggtattaatgcgattatcgaagtggacctgctgagcaagtcgtacaagttgctgatctctggtgaactgaagatcttgatgctgaatagcaatcacattcagcagaagatcgattacattggtttcaacagcgagttgcaaaagaatattccttactcgttcgtggacagcgaaggcaaagaaaacggtttcatcaatggcagcactaaggagggtttgttcgtgtcggagctgccggatgtcgtcctgatttctaaggtctatatggatgactcgaaaccgtcctttggttactactctaacaacctgaaagatgttaaagtgatcaccaaggataatgtcaacattctgacgggttactatctgaaggacgatatcaagatcagcttgagcctgaccctgcaggacgagaagaccattaaactgaactcggttcacctggatgagagcggtgtggcggaaatcttgaaattcatgaaccgcaaaggcaataccaacacctccgatagcctgatgagctttctggaaagcatgaacattaagagcatcttcgttaattttctgcagagcaacatcaaattcattctggatgcgaactttattatcagcggcacgacctccattggccagttcgaattcatttgtgatgagaatgacaatatccaaccgtatttcattaagtttaacaccctggagacgaactacaccctgtacgtcggcaaccgccaaaatatgatcgttgaaccaaactacgacttggacgactctggtgacatcagctcgaccgttatcaatttcagccagaagtacctgtacggtattgacagctgcgtcaacaaggttgtgatttcgccaaacatctacaccgacgaaattaatatcaccccggtgtatgagaccaacaatacgtaccctgaggtgatcgtcctggacgcgaactacattaatgagaaaatcaacgtgaacatcaatgatctgtcgattcgttacgtctggtcgaacgatggcaacgactttattttgatgagcacctctgaagaaaacaaagtgagccaagtgaagatccgtttcgtcaacgtctttaaggacaagaccctggctaataagctgtcgttcaatttttccgacaaacaagacgttcctgtgagcgaaattattctgtcctttaccccgtcctattacgaagacggcctgatcggttacgacctgggtttggttagcctgtataatgaaaaattctacattaacaacttcggtatgatggtgagcggtctgatttacatcaacgactccctgtactacttcaagccgccagttaacaacctgatcaccggcttcgtcactgttggtgacgacaaatactacttcaaccctatcaacggcggtgctgcttccatcggtgagactatcatcgacgacaaaaactactatttcaaccaatccggcgttctgcagaccggtgttttctctaccgaggacggtttcaaatacttcgcaccggcaaacaccctggacgaaaatctggagggtgaggctatcgacttcacgggtaaactgatcatcgatgaaaacatctattactttgacgacaactaccgcggtgctgtggagtggaaagaactggacggtgagatgcactacttttctccggaaaccggcaaggcgttcaaaggtctgaaccagatcggtgactacaaatattactttaacagcgacggtgttatgcagaagggcttcgttagcattaacgataacaaacactatttcgatgactctggtgttatgaaagttggttataccgagattgacggcaagcacttctacttcgcagaaaacggtgaaatgcagatcggtgtgttcaacactgaagatggctttaagtatttcgcacaccacaacgaagacctgggtaacgaagagggcgaagagatctcctactccggtattctgaatttcaacaacaaaatctactatttcgacgactccttcactgcagtagttggttggaaagatctggaggacggctctaaatactatttcgatgaggacactgctgaggcgtacatcggcctgtccctgattaacgacggccagtactattttaacgatgacggcattatgcaggtgggcttcgtcaccatcaacgacaaagtattttacttcagcgacagcggtatcatcgaatctggtgttcagaacattgatgacaactacttctacattgacgacaacggcatcgtacagattggtgtgttcgacacgtctgacggttacaaatacttcgctccggctaacaccgtgaacgacaacatctatggtcaggcagtggaatactctggtctggttcgtgtgggcgaagacgtttattacttcggcgaaacctacacgatcgaaaccggctggatctatgacatggagaacgaatctgacaaatactattttaacccggaaaccaaaaaggcgtgcaaaggcatcaacctgatcgatgacatcaaatattactttgacgaaaaaggtattatgcgtactggcctgatctctttcgaaaacaacaactactacttcaacgagaacggcgaaatgcaatttggctacatcaacatcgaggataaaatgttttactttggcgaagacggcgttatgcagatcggcgtttttaacaccccggacggttttaagtacttcgcgcaccagaacacgctggatgaaaacttcgagggcgaatctatcaattataccggttggctggatctggatgaaaaacgctattacttcacggacgagtacatcgcggctactggctctgttatcatcgacggtgaggaatattacttcgacccagacacggcacagctggtaatttccgaactcgagcaccaccaccaccaccactga

SEQ ID NO: 16 - DNA, 7125 bp, Artificial Sequence
  VPI 10463 strain, E. coli optimized W102A, D286A, D288A, E515Q TcdB (Quad D286)
atgtccctggtgaatcgcaaacagctggaaaagatggctaacgttcgttttcgcacccaggaggatgagtacgtggctattctggatgcgctggaggagtaccataatatgtctgaaaataccgttgtcgagaaatatttgaaactgaaggacattaactcgttgaccgacatctacattgacacctacaagaaaagcggtcgtaacaaagcgttgaagaagttcaaggagtatctggttacggaggtgctggaactgaagaataataacttgaccccggtggaaaagaatctgcatttcgtcgccattggtggtcaaatcaacgataccgcgattaactatatcaaccaatggaaggacgtcaacagcgattacaatgttaatgtgttttatgatagcaatgcattcttgattaacacgctgaaaaagaccgtggttgagtcggccattaacgacaccctggagagctttcgcgagaacctgaacgacccgcgtttcgactacaacaagtttttccgtaaacgcatggagattatctacgacaagcagaagaatttcattaactattacaaggcgcagcgtgaggaaaatccggaactgatcattgacgacattgtgaaaacttacctgagcaacgaatactccaaagaaatcgatgagttgaacacctatattgaggagagcctgaacaagattacccaaaattctggcaatgatgttcgtaacttcgaggaatttaagaatggtgagtccttcaacctgtatgaacaagaactggtggagcgttggaacctggcagccgcgtccgacatcctgcgcattagcgcgctgaaggaaattggtggcatgtatctggctgttgctatgctgccgggcattcagccggatttgtttgaatcgattgagaaaccgtcgagcgtgaccgttgacttttgggagatgaccaaattggaggcgattatgaagtacaaagagtatattccggagtataccagcgaacactttgacatgttggacgaagaggttcaatcgagcttcgagtccgttttggcctcgaaaagcgacaaatcggagattttctcgtcgctgggcgacatggaggcgagcccgctggaagtgaagatcgccttcaattcgaagggtatcattaatcaaggtctgatctccgtgaaagactcctactgtagcaacttgatcgtcaagcaaattgaaaaccgctacaagattctgaataactccctgaatccggcgatttctgaagataatgacttcaacaccaccacgaatacgttcatcgacagcatcatggctgaggcgaacgcagacaatggccgtttcatgatggaactgggcaaatatctgcgtgtgggtttctttccggacgttaaaacgacgattaacctgtccggtccggaggcttacgccgcagcctatcaagatctgctgatgttcaaagaaggctccatgaatatccacctgatcgaagctgacctgcgtaattttgagatctcgaagaccaacattagccagtcgacggaacaacaaatggcgagcttgtggtcttttgatgatgcgcgcgctaaagcccaattcgaggagtacaagcgtaactatttcgagggtagcctgggcgaagatgacaacctggacttcagccagaatatcgtcgtggataaggagtacctgctggagaagatttccagcctggctcgtagcagcgagcgcggttacattcattacatcgtccagctgcaaggtgataagatttcgtatgaggcggcgtgtaatctgtttgcaaaaaccccgtacgacagcgttctgtttcaaaagaacattgaggacagcgagattgcatattactacaacccgggtgacggtgaaatccaggagattgataagtacaagattccaagcatcattagcgatcgcccaaagattaaattgaccttcatcggccacggcaaggatgagttcaatacggacatcttcgcgggctttgacgtggactctctgagcacggagattgaggcagcgattgacctggcgaaggaggatatttctccaaagtccatcgaaattaacttgttgggttgtaatatgttcagctactctatcaacgtcgaggagacctatccgggtaagctgctgctgaaggttaaagacaagatttcggagttgatgccgagcatttcgcaggacagcattattgtgtccgctaaccagtatgaagttcgcatcaattccgagggccgccgcgaactgttggaccatagcggtgagtggattaacaaagaggagtctatcatcaaagatatctcctcgaaagaatacatttcttttaacccgaaagagaataaaatcaccgttaagtccaaaaatctgccagagctgagcaccctgttgcaggaaatccgtaacaacagcaattcttcggatatcgaactggaagaaaaggttatgctgaccgagtgcgagattaacgtcattagcaatatcgatacgcagattgtcgaggagcgtattgaagaagcgaagaacctgacgagcgactccatcaattacattaaggacgagtttaagttgattgagagcatttccgacgcgctgtgcgatttgaaacaacagaacgagctggaagattcccacttcatctcgtttgaggatatcagcgaaactgacgaaggtttttccatccgcttcatcaataaggagactggtgaaagcatcttcgttgaaaccgaaaagaccatcttctccgaatatgcgaaccacattaccgaggagatttccaaaatcaaaggtactatttttgacaccgtcaacggtaagttggtgaaaaaggttaatctggataccacgcatgaagtgaataccttgaacgctgcattcttcattcagtctctgattgagtacaatagctccaaggaatccctgtccaatctgagcgtggcgatgaaagttcaagtgtatgcgcaactgttttctactggtttgaacacgattaccgatgcggcaaaagtggtcgagctggttagcaccgcgctggacgagacgatcgatttgctgccgaccctgagcgagggtctgccaatcatcgctacgatcatcgatggtgtgagcttgggtgcggcgattaaggaactgtctgaaaccagcgatccgctgctgcgccaggaaattgaggccaagatcggcattatggcggtcaatctgaccaccgcgaccaccgcaattattacgagctccctgggtattgcgtctggcttcagcatcctgctggtgccgctggcgggtatttctgcaggcattccaagcttggtgaataatgagttggtgctgcgtgacaaagcaaccaaagttgttgattacttcaagcatgtttccttggtggaaactgaaggtgtgttcacgctgctggacgataaaattatgatgcctcaggatgacctggtgattagcgaaatcgactttaacaacaacagcattgtgttgggtaagtgtgagatctggcgcatggaaggtggttccggccacaccgttaccgacgacattgaccacttcttctcggcgccgtctattacttaccgtgagccgcacctgtcgatttatgatgttctggaggtgcagaaagaagagctggacctgtcgaaggatttgatggttctgccgaacgcccctaatcgcgttttcgcgtgggagactggttggaccccgggtctgcgttcgctggagaatgacggtaccaagctgttggaccgtatccgtgacaattatgagggtgagttttactggcgttattttgcctttatcgccgatgcgctgatcaccaccctgaaaccgcgctatgaagacactaacattcgcatcaacttggacagcaatacccgttcgtttatcgtgccgatcattaccaccgagtatatccgtgagaaactgtcctactcgttctacggttccggcggcacgtacgctctgtctctgagccagtacaacatgggcattaatatcgagctgtccgagtccgatgtgtggattattgacgttgacaacgtcgtccgcgacgttaccatcgagagcgataaaatcaaaaagggtgatctgattgagggtattctgtctaccttgtccatcgaggagaataagattattctgaatagccatgagatcaacttctcgggtgaggtgaatggttccaatggttttgtttctctgaccttctccattctggagggtattaatgcgattatcgaagtggacctgctgagcaagtcgtacaagttgctgatctctggtgaactgaagatcttgatgctgaatagcaatcacattcagcagaagatcgattacattggtttcaacagcgagttgcaaaagaatattccttactcgttcgtggacagcgaaggcaaagaaaacggtttcatcaatggcagcactaaggagggtttgttcgtgtcggagctgccggatgtcgtcctgatttctaaggtctatatggatgactcgaaaccgtcctttggttactactctaacaacctgaaagatgttaaagtgatcaccaaggataatgtcaacattctgacgggttactatctgaaggacgatatcaagatcagcttgagcctgaccctgcaggacgagaagaccattaaactgaactcggttcacctggatgagagcggtgtggcggaaatcttgaaattcatgaaccgcaaaggcaataccaacacctccgatagcctgatgagctttctggaaagcatgaacattaagagcatcttcgttaattttctgcagagcaacatcaaattcattctggatgcgaactttattatcagcggcacgacctccattggccagttcgaattcatttgtgatgagaatgacaatatccaaccgtatttcattaagtttaacaccctggagacgaactacaccctgtacgtcggcaaccgccaaaatatgatcgttgaaccaaactacgacttggacgactctggtgacatcagctcgaccgttatcaatttcagccagaagtacctgtacggtattgacagctgcgtcaacaaggttgtgatttcgccaaacatctacaccgacgaaattaatatcaccccggtgtatgagaccaacaatacgtaccctgaggtgatcgtcctggacgcgaactacattaatgagaaaatcaacgtgaacatcaatgatctgtcgattcgttacgtctggtcgaacgatggcaacgactttattttgatgagcacctctgaagaaaacaaagtgagccaagtgaagatccgtttcgtcaacgtctttaaggacaagaccctggctaataagctgtcgttcaatttttccgacaaacaagacgttcctgtgagcgaaattattctgtcctttaccccgtcctattacgaagacggcctgatcggttacgacctgggtttggttagcctgtataatgaaaaattctacattaacaacttcggtatgatggtgagcggtctgatttacatcaacgactccctgtactacttcaagccgccagttaacaacctgatcaccggcttcgtcactgttggtgacgacaaatactacttcaaccctatcaacggcggtgctgcttccatcggtgagactatcatcgacgacaaaaactactatttcaaccaatccggcgttctgcagaccggtgttttctctaccgaggacggtttcaaatacttcgcaccggcaaacaccctggacgaaaatctggagggtgaggctatcgacttcacgggtaaactgatcatcgatgaaaacatctattactttgacgacaactaccgcggtgctgtggagtggaaagaactggacggtgagatgcactacttttctccggaaaccggcaaggcgttcaaaggtctgaaccagatcggtgactacaaatattactttaacagcgacggtgttatgcagaagggcttcgttagcattaacgataacaaacactatttcgatgactctggtgttatgaaagttggttataccgagattgacggcaagcacttctacttcgcagaaaacggtgaaatgcagatcggtgtgttcaacactgaagatggctttaagtatttcgcacaccacaacgaagacctgggtaacgaagagggcgaagagatctcctactccggtattctgaatttcaacaacaaaatctactatttcgacgactccttcactgcagtagttggttggaaagatctggaggacggctctaaatactatttcgatgaggacactgctgaggcgtacatcggcctgtccctgattaacgacggccagtactattttaacgatgacggcattatgcaggtgggcttcgtcaccatcaacgacaaagtattttacttcagcgacagcggtatcatcgaatctggtgttcagaacattgatgacaactacttctacattgacgacaacggcatcgtacagattggtgtgttcgacacgtctgacggttacaaatacttcgctccggctaacaccgtgaacgacaacatctatggtcaggcagtggaatactctggtctggttcgtgtgggcgaagacgtttattacttcggcgaaacctacacgatcgaaaccggctggatctatgacatggagaacgaatctgacaaatactattttaacccggaaaccaaaaaggcgtgcaaaggcatcaacctgatcgatgacatcaaatattactttgacgaaaaaggtattatgcgtactggcctgatctctttcgaaaacaacaactactacttcaacgagaacggcgaaatgcaatttggctacatcaacatcgaggataaaatgttttactttggcgaagacggcgttatgcagatcggcgtttttaacaccccggacggttttaagtacttcgcgcaccagaacacgctggatgaaaacttcgagggcgaatctatcaattataccggttggctggatctggatgaaaaacgctattacttcacggacgagtacatcgcggctactggctctgttatcatcgacggtgaggaatattacttcgacccagacacggcacagctggtaatttccgaactcgagcaccaccaccaccaccactga

SEQ ID NO: 17 - DNA, 7125 bp, Artificial Sequence
  VPI 10463 strain, E. coli optimized W102A, D288A, E515Q, S518A TcdB (Quad S518)
atgtccctggtgaatcgcaaacagctggaaaagatggctaacgttcgttttcgcacccaggaggatgagtacgtggctattctggatgcgctggaggagtaccataatatgtctgaaaataccgttgtcgagaaatatttgaaactgaaggacattaactcgttgaccgacatctacattgacacctacaagaaaagcggtcgtaacaaagcgttgaagaagttcaaggagtatctggttacggaggtgctggaactgaagaataataacttgaccccggtggaaaagaatctgcatttcgtcgccattggtggtcaaatcaacgataccgcgattaactatatcaaccaatggaaggacgtcaacagcgattacaatgttaatgtgttttatgatagcaatgcattcttgattaacacgctgaaaaagaccgtggttgagtcggccattaacgacaccctggagagctttcgcgagaacctgaacgacccgcgtttcgactacaacaagtttttccgtaaacgcatggagattatctacgacaagcagaagaatttcattaactattacaaggcgcagcgtgaggaaaatccggaactgatcattgacgacattgtgaaaacttacctgagcaacgaatactccaaagaaatcgatgagttgaacacctatattgaggagagcctgaacaagattacccaaaattctggcaatgatgttcgtaacttcgaggaatttaagaatggtgagtccttcaacctgtatgaacaagaactggtggagcgttggaacctggcagccgcgtccgacatcctgcgcattagcgcgctgaaggaaattggtggcatgtatctggatgttgctatgctgccgggcattcagccggatttgtttgaatcgattgagaaaccgtcgagcgtgaccgttgacttttgggagatgaccaaattggaggcgattatgaagtacaaagagtatattccggagtataccagcgaacactttgacatgttggacgaagaggttcaatcgagcttcgagtccgttttggcctcgaaaagcgacaaatcggagattttctcgtcgctgggcgacatggaggcgagcccgctggaagtgaagatcgccttcaattcgaagggtatcattaatcaaggtctgatctccgtgaaagactcctactgtagcaacttgatcgtcaagcaaattgaaaaccgctacaagattctgaataactccctgaatccggcgatttctgaagataatgacttcaacaccaccacgaatacgttcatcgacagcatcatggctgaggcgaacgcagacaatggccgtttcatgatggaactgggcaaatatctgcgtgtgggtttctttccggacgttaaaacgacgattaacctgtccggtccggaggcttacgccgcagcctatcaagatctgctgatgttcaaagaaggctccatgaatatccacctgatcgaagctgacctgcgtaattttgagatctcgaagaccaacattagccagtcgacggaacaacaaatggcggccttgtggtcttttgatgatgcgcgcgctaaagcccaattcgaggagtacaagcgtaactatttcgagggtagcctgggcgaagatgacaacctggacttcagccagaatatcgtcgtggataaggagtacctgctggagaagatttccagcctggctcgtagcagcgagcgcggttacattcattacatcgtccagctgcaaggtgataagatttcgtatgaggcggcgtgtaatctgtttgcaaaaaccccgtacgacagcgttctgtttcaaaagaacattgaggacagcgagattgcatattactacaacccgggtgacggtgaaatccaggagattgataagtacaagattccaagcatcattagcgatcgcccaaagattaaattgaccttcatcggccacggcaaggatgagttcaatacggacatcttcgcgggctttgacgtggactctctgagcacggagattgaggcagcgattgacctggcgaaggaggatatttctccaaagtccatcgaaattaacttgttgggttgtaatatgttcagctactctatcaacgtcgaggagacctatccgggtaagctgctgctgaaggttaaagacaagatttcggagttgatgccgagcatttcgcaggacagcattattgtgtccgctaaccagtatgaagttcgcatcaattccgagggccgccgcgaactgttggaccatagcggtgagtggattaacaaagaggagtctatcatcaaagatatctcctcgaaagaatacatttcttttaacccgaaagagaataaaatcaccgttaagtccaaaaatctgccagagctgagcaccctgttgcaggaaatccgtaacaacagcaattcttcggatatcgaactggaagaaaaggttatgctgaccgagtgcgagattaacgtcattagcaatatcgatacgcagattgtcgaggagcgtattgaagaagcgaagaacctgacgagcgactccatcaattacattaaggacgagtttaagttgattgagagcatttccgacgcgctgtgcgatttgaaacaacagaacgagctggaagattcccacttcatctcgtttgaggatatcagcgaaactgacgaaggtttttccatccgcttcatcaataaggagactggtgaaagcatcttcgttgaaaccgaaaagaccatcttctccgaatatgcgaaccacattaccgaggagatttccaaaatcaaaggtactatttttgacaccgtcaacggtaagttggtgaaaaaggttaatctggataccacgcatgaagtgaataccttgaacgctgcattcttcattcagtctctgattgagtacaatagctccaaggaatccctgtccaatctgagcgtggcgatgaaagttcaagtgtatgcgcaactgttttctactggtttgaacacgattaccgatgcggcaaaagtggtcgagctggttagcaccgcgctggacgagacgatcgatttgctgccgaccctgagcgagggtctgccaatcatcgctacgatcatcgatggtgtgagcttgggtgcggcgattaaggaactgtctgaaaccagcgatccgctgctgcgccaggaaattgaggccaagatcggcattatggcggtcaatctgaccaccgcgaccaccgcaattattacgagctccctgggtattgcgtctggcttcagcatcctgctggtgccgctggcgggtatttctgcaggcattccaagcttggtgaataatgagttggtgctgcgtgacaaagcaaccaaagttgttgattacttcaagcatgtttccttggtggaaactgaaggtgtgttcacgctgctggacgataaaattatgatgcctcaggatgacctggtgattagcgaaatcgactttaacaacaacagcattgtgttgggtaagtgtgagatctggcgcatggaaggtggttccggccacaccgttaccgacgacattgaccacttcttctcggcgccgtctattacttaccgtgagccgcacctgtcgatttatgatgttctggaggtgcagaaagaagagctggacctgtcgaaggatttgatggttctgccgaacgcccctaatcgcgttttcgcgtgggagactggttggaccccgggtctgcgttcgctggagaatgacggtaccaagctgttggaccgtatccgtgacaattatgagggtgagttttactggcgttattttgcctttatcgccgatgcgctgatcaccaccctgaaaccgcgctatgaagacactaacattcgcatcaacttggacagcaatacccgttcgtttatcgtgccgatcattaccaccgagtatatccgtgagaaactgtcctactcgttctacggttccggcggcacgtacgctctgtctctgagccagtacaacatgggcattaatatcgagctgtccgagtccgatgtgtggattattgacgttgacaacgtcgtccgcgacgttaccatcgagagcgataaaatcaaaaagggtgatctgattgagggtattctgtctaccttgtccatcgaggagaataagattattctgaatagccatgagatcaacttctcgggtgaggtgaatggttccaatggttttgtttctctgaccttctccattctggagggtattaatgcgattatcgaagtggacctgctgagcaagtcgtacaagttgctgatctctggtgaactgaagatcttgatgctgaatagcaatcacattcagcagaagatcgattacattggtttcaacagcgagttgcaaaagaatattccttactcgttcgtggacagcgaaggcaaagaaaacggtttcatcaatggcagcactaaggagggtttgttcgtgtcggagctgccggatgtcgtcctgatttctaaggtctatatggatgactcgaaaccgtcctttggttactactctaacaacctgaaagatgttaaagtgatcaccaaggataatgtcaacattctgacgggttactatctgaaggacgatatcaagatcagcttgagcctgaccctgcaggacgagaagaccattaaactgaactcggttcacctggatgagagcggtgtggcggaaatcttgaaattcatgaaccgcaaaggcaataccaacacctccgatagcctgatgagctttctggaaagcatgaacattaagagcatcttcgttaattttctgcagagcaacatcaaattcattctggatgcgaactttattatcagcggcacgacctccattggccagttcgaattcatttgtgatgagaatgacaatatccaaccgtatttcattaagtttaacaccctggagacgaactacaccctgtacgtcggcaaccgccaaaatatgatcgttgaaccaaactacgacttggacgactctggtgacatcagctcgaccgttatcaatttcagccagaagtacctgtacggtattgacagctgcgtcaacaaggttgtgatttcgccaaacatctacaccgacgaaattaatatcaccccggtgtatgagaccaacaatacgtaccctgaggtgatcgtcctggacgcgaactacattaatgagaaaatcaacgtgaacatcaatgatctgtcgattcgttacgtctggtcgaacgatggcaacgactttattttgatgagcacctctgaagaaaacaaagtgagccaagtgaagatccgtttcgtcaacgtctttaaggacaagaccctggctaataagctgtcgttcaatttttccgacaaacaagacgttcctgtgagcgaaattattctgtcctttaccccgtcctattacgaagacggcctgatcggttacgacctgggtttggttagcctgtataatgaaaaattctacattaacaacttcggtatgatggtgagcggtctgatttacatcaacgactccctgtactacttcaagccgccagttaacaacctgatcaccggcttcgtcactgttggtgacgacaaatactacttcaaccctatcaacggcggtgctgcttccatcggtgagactatcatcgacgacaaaaactactatttcaaccaatccggcgttctgcagaccggtgttttctctaccgaggacggtttcaaatacttcgcaccggcaaacaccctggacgaaaatctggagggtgaggctatcgacttcacgggtaaactgatcatcgatgaaaacatctattactttgacgacaactaccgcggtgctgtggagtggaaagaactggacggtgagatgcactacttttctccggaaaccggcaaggcgttcaaaggtctgaaccagatcggtgactacaaatattactttaacagcgacggtgttatgcagaagggcttcgttagcattaacgataacaaacactatttcgatgactctggtgttatgaaagttggttataccgagattgacggcaagcacttctacttcgcagaaaacggtgaaatgcagatcggtgtgttcaacactgaagatggctttaagtatttcgcacaccacaacgaagacctgggtaacgaagagggcgaagagatctcctactccggtattctgaatttcaacaacaaaatctactatttcgacgactccttcactgcagtagttggttggaaagatctggaggacggctctaaatactatttcgatgaggacactgctgaggcgtacatcggcctgtccctgattaacgacggccagtactattttaacgatgacggcattatgcaggtgggcttcgtcaccatcaacgacaaagtattttacttcagcgacagcggtatcatcgaatctggtgttcagaacattgatgacaactacttctacattgacgacaacggcatcgtacagattggtgtgttcgacacgtctgacggttacaaatacttcgctccggctaacaccgtgaacgacaacatctatggtcaggcagtggaatactctggtctggttcgtgtgggcgaagacgtttattacttcggcgaaacctacacgatcgaaaccggctggatctatgacatggagaacgaatctgacaaatactattttaacccggaaaccaaaaaggcgtgcaaaggcatcaacctgatcgatgacatcaaatattactttgacgaaaaaggtattatgcgtactggcctgatctctttcgaaaacaacaactactacttcaacgagaacggcgaaatgcaatttggctacatcaacatcgaggataaaatgttttactttggcgaagacggcgttatgcagatcggcgtttttaacaccccggacggttttaagtacttcgcgcaccagaacacgctggatgaaaacttcgagggcgaatctatcaattataccggttggctggatctggatgaaaaacgctattacttcacggacgagtacatcgcggctactggctctgttatcatcgacggtgaggaatattacttcgacccagacacggcacagctggtaatttccgaactcgagcaccaccaccaccaccactga

SEQ ID NO: 18 - DNA, 7125 bp, Artificial Sequence
  VPI 10463 strain, E. coli optimized W102A, D288A, E515Q, W520A TcdB (Quad W520)
atgtccctggtgaatcgcaaacagctggaaaagatggctaacgttcgttttcgcacccaggaggatgagtacgtggctattctggatgcgctggaggagtaccataatatgtctgaaaataccgttgtcgagaaatatttgaaactgaaggacattaactcgttgaccgacatctacattgacacctacaagaaaagcggtcgtaacaaagcgttgaagaagttcaaggagtatctggttacggaggtgctggaactgaagaataataacttgaccccggtggaaaagaatctgcatttcgtcgccattggtggtcaaatcaacgataccgcgattaactatatcaaccaatggaaggacgtcaacagcgattacaatgttaatgtgttttatgatagcaatgcattcttgattaacacgctgaaaaagaccgtggttgagtcggccattaacgacaccctggagagctttcgcgagaacctgaacgacccgcgtttcgactacaacaagtttttccgtaaacgcatggagattatctacgacaagcagaagaatttcattaactattacaaggcgcagcgtgaggaaaatccggaactgatcattgacgacattgtgaaaacttacctgagcaacgaatactccaaagaaatcgatgagttgaacacctatattgaggagagcctgaacaagattacccaaaattctggcaatgatgttcgtaacttcgaggaatttaagaatggtgagtccttcaacctgtatgaacaagaactggtggagcgttggaacctggcagccgcgtccgacatcctgcgcattagcgcgctgaaggaaattggtggcatgtatctggatgttgctatgctgccgggcattcagccggatttgtttgaatcgattgagaaaccgtcgagcgtgaccgttgacttttgggagatgaccaaattggaggcgattatgaagtacaaagagtatattccggagtataccagcgaacactttgacatgttggacgaagaggttcaatcgagcttcgagtccgttttggcctcgaaaagcgacaaatcggagattttctcgtcgctgggcgacatggaggcgagcccgctggaagtgaagatcgccttcaattcgaagggtatcattaatcaaggtctgatctccgtgaaagactcctactgtagcaacttgatcgtcaagcaaattgaaaaccgctacaagattctgaataactccctgaatccggcgatttctgaagataatgacttcaacaccaccacgaatacgttcatcgacagcatcatggctgaggcgaacgcagacaatggccgtttcatgatggaactgggcaaatatctgcgtgtgggtttctttccggacgttaaaacgacgattaacctgtccggtccggaggcttacgccgcagcctatcaagatctgctgatgttcaaagaaggctccatgaatatccacctgatcgaagctgacctgcgtaattttgagatctcgaagaccaacattagccagtcgacggaacaacaaatggcgagcttggcgtcttttgatgatgcgcgcgctaaagcccaattcgaggagtacaagcgtaactatttcgagggtagcctgggcgaagatgacaacctggacttcagccagaatatcgtcgtggataaggagtacctgctggagaagatttccagcctggctcgtagcagcgagcgcggttacattcattacatcgtccagctgcaaggtgataagatttcgtatgaggcggcgtgtaatctgtttgcaaaaaccccgtacgacagcgttctgtttcaaaagaacattgaggacagcgagattgcatattactacaacccgggtgacggtgaaatccaggagattgataagtacaagattccaagcatcattagcgatcgcccaaagattaaattgaccttcatcggccacggcaaggatgagttcaatacggacatcttcgcgggctttgacgtggactctctgagcacggagattgaggcagcgattgacctggcgaaggaggatatttctccaaagtccatcgaaattaacttgttgggttgtaatatgttcagctactctatcaacgtcgaggagacctatccgggtaagctgctgctgaaggttaaagacaagatttcggagttgatgccgagcatttcgcaggacagcattattgtgtccgctaaccagtatgaagttcgcatcaattccgagggccgccgcgaactgttggaccatagcggtgagtggattaacaaagaggagtctatcatcaaagatatctcctcgaaagaatacatttcttttaacccgaaagagaataaaatcaccgttaagtccaaaaatctgccagagctgagcaccctgttgcaggaaatccgtaacaacagcaattcttcggatatcgaactggaagaaaaggttatgctgaccgagtgcgagattaacgtcattagcaatatcgatacgcagattgtcgaggagcgtattgaagaagcgaagaacctgacgagcgactccatcaattacattaaggacgagtttaagttgattgagagcatttccgacgcgctgtgcgatttgaaacaacagaacgagctggaagattcccacttcatctcgtttgaggatatcagcgaaactgacgaaggtttttccatccgcttcatcaataaggagactggtgaaagcatcttcgttgaaaccgaaaagaccatcttctccgaatatgcgaaccacattaccgaggagatttccaaaatcaaaggtactatttttgacaccgtcaacggtaagttggtgaaaaaggttaatctggataccacgcatgaagtgaataccttgaacgctgcattcttcattcagtctctgattgagtacaatagctccaaggaatccctgtccaatctgagcgtggcgatgaaagttcaagtgtatgcgcaactgttttctactggtttgaacacgattaccgatgcggcaaaagtggtcgagctggttagcaccgcgctggacgagacgatcgatttgctgccgaccctgagcgagggtctgccaatcatcgctacgatcatcgatggtgtgagcttgggtgcggcgattaaggaactgtctgaaaccagcgatccgctgctgcgccaggaaattgaggccaagatcggcattatggcggtcaatctgaccaccgcgaccaccgcaattattacgagctccctgggtattgcgtctggcttcagcatcctgctggtgccgctggcgggtatttctgcaggcattccaagcttggtgaataatgagttggtgctgcgtgacaaagcaaccaaagttgttgattacttcaagcatgtttccttggtggaaactgaaggtgtgttcacgctgctggacgataaaattatgatgcctcaggatgacctggtgattagcgaaatcgactttaacaacaacagcattgtgttgggtaagtgtgagatctggcgcatggaaggtggttccggccacaccgttaccgacgacattgaccacttcttctcggcgccgtctattacttaccgtgagccgcacctgtcgatttatgatgttctggaggtgcagaaagaagagctggacctgtcgaaggatttgatggttctgccgaacgcccctaatcgcgttttcgcgtgggagactggttggaccccgggtctgcgttcgctggagaatgacggtaccaagctgttggaccgtatccgtgacaattatgagggtgagttttactggcgttattttgcctttatcgccgatgcgctgatcaccaccctgaaaccgcgctatgaagacactaacattcgcatcaacttggacagcaatacccgttcgtttatcgtgccgatcattaccaccgagtatatccgtgagaaactgtcctactcgttctacggttccggcggcacgtacgctctgtctctgagccagtacaacatgggcattaatatcgagctgtccgagtccgatgtgtggattattgacgttgacaacgtcgtccgcgacgttaccatcgagagcgataaaatcaaaaagggtgatctgattgagggtattctgtctaccttgtccatcgaggagaataagattattctgaatagccatgagatcaacttctcgggtgaggtgaatggttccaatggttttgtttctctgaccttctccattctggagggtattaatgcgattatcgaagtggacctgctgagcaagtcgtacaagttgctgatctctggtgaactgaagatcttgatgctgaatagcaatcacattcagcagaagatcgattacattggtttcaacagcgagttgcaaaagaatattccttactcgttcgtggacagcgaaggcaaagaaaacggtttcatcaatggcagcactaaggagggtttgttcgtgtcggagctgccggatgtcgtcctgatttctaaggtctatatggatgactcgaaaccgtcctttggttactactctaacaacctgaaagatgttaaagtgatcaccaaggataatgtcaacattctgacgggttactatctgaaggacgatatcaagatcagcttgagcctgaccctgcaggacgagaagaccattaaactgaactcggttcacctggatgagagcggtgtggcggaaatcttgaaattcatgaaccgcaaaggcaataccaacacctccgatagcctgatgagctttctggaaagcatgaacattaagagcatcttcgttaattttctgcagagcaacatcaaattcattctggatgcgaactttattatcagcggcacgacctccattggccagttcgaattcatttgtgatgagaatgacaatatccaaccgtatttcattaagtttaacaccctggagacgaactacaccctgtacgtcggcaaccgccaaaatatgatcgttgaaccaaactacgacttggacgactctggtgacatcagctcgaccgttatcaatttcagccagaagtacctgtacggtattgacagctgcgtcaacaaggttgtgatttcgccaaacatctacaccgacgaaattaatatcaccccggtgtatgagaccaacaatacgtaccctgaggtgatcgtcctggacgcgaactacattaatgagaaaatcaacgtgaacatcaatgatctgtcgattcgttacgtctggtcgaacgatggcaacgactttattttgatgagcacctctgaagaaaacaaagtgagccaagtgaagatccgtttcgtcaacgtctttaaggacaagaccctggctaataagctgtcgttcaatttttccgacaaacaagacgttcctgtgagcgaaattattctgtcctttaccccgtcctattacgaagacggcctgatcggttacgacctgggtttggttagcctgtataatgaaaaattctacattaacaacttcggtatgatggtgagcggtctgatttacatcaacgactccctgtactacttcaagccgccagttaacaacctgatcaccggcttcgtcactgttggtgacgacaaatactacttcaaccctatcaacggcggtgctgcttccatcggtgagactatcatcgacgacaaaaactactatttcaaccaatccggcgttctgcagaccggtgttttctctaccgaggacggtttcaaatacttcgcaccggcaaacaccctggacgaaaatctggagggtgaggctatcgacttcacgggtaaactgatcatcgatgaaaacatctattactttgacgacaactaccgcggtgctgtggagtggaaagaactggacggtgagatgcactacttttctccggaaaccggcaaggcgttcaaaggtctgaaccagatcggtgactacaaatattactttaacagcgacggtgttatgcagaagggcttcgttagcattaacgataacaaacactatttcgatgactctggtgttatgaaagttggttataccgagattgacggcaagcacttctacttcgcagaaaacggtgaaatgcagatcggtgtgttcaacactgaagatggctttaagtatttcgcacaccacaacgaagacctgggtaacgaagagggcgaagagatctcctactccggtattctgaatttcaacaacaaaatctactatttcgacgactccttcactgcagtagttggttggaaagatctggaggacggctctaaatactatttcgatgaggacactgctgaggcgtacatcggcctgtccctgattaacgacggccagtactattttaacgatgacggcattatgcaggtgggcttcgtcaccatcaacgacaaagtattttacttcagcgacagcggtatcatcgaatctggtgttcagaacattgatgacaactacttctacattgacgacaacggcatcgtacagattggtgtgttcgacacgtctgacggttacaaatacttcgctccggctaacaccgtgaacgacaacatctatggtcaggcagtggaatactctggtctggttcgtgtgggcgaagacgtttattacttcggcgaaacctacacgatcgaaaccggctggatctatgacatggagaacgaatctgacaaatactattttaacccggaaaccaaaaaggcgtgcaaaggcatcaacctgatcgatgacatcaaatattactttgacgaaaaaggtattatgcgtactggcctgatctctttcgaaaacaacaactactacttcaacgagaacggcgaaatgcaatttggctacatcaacatcgaggataaaatgttttactttggcgaagacggcgttatgcagatcggcgtttttaacaccccggacggttttaagtacttcgcgcaccagaacacgctggatgaaaacttcgagggcgaatctatcaattataccggttggctggatctggatgaaaaacgctattacttcacggacgagtacatcgcggctactggctctgttatcatcgacggtgaggaatattacttcgacccagacacggcacagctggtaatttccgaactcgagcaccaccaccaccaccactga

SEQ ID NO: 19 - protein, 2367 aa, Artificial Sequence
  VPI 10463 strain, W102A, D288A, E515Q TcdB (Tri)
MGSLVNRKQLEKMANVRFRTQEDEYVAILDALEEYHNMSENTVVEKYLKLKDINSLTDIYIDTYKKSGRNKALKKFKEYLVTEVLELKNNNLTPVEKNLHFVAIGGQINDTAINYINQWKDVNSDYNVNVFYDSNAFLINTLKKTVVESAINDTLESFRENLNDPRFDYNKFFRKRMEIIYDKQKNFINYYKAQREENPELIIDDIVKTYLSNEYSKEIDELNTYIEESLNKITQNSGNDVRNFEEFKNGESFNLYEQELVERWNLAAASDILRISALKEIGGMYLDVAMLPGIQPDLFESIEKPSSVTVDFWEMTKLEAIMKYKEYIPEYTSEHFDMLDEEVQSSFESVLASKSDKSEIFSSLGDMEASPLEVKIAFNSKGIINQGLISVKDSYCSNLIVKQIENRYKILNNSLNPAISEDNDFNTTTNTFIDSIMAEANADNGRFMMELGKYLRVGFFPDVKTTINLSGPEAYAAAYQDLLMFKEGSMNIHLIEADLRNFEISKTNISQSTEQQMASLWSFDDARAKAQFEEYKRNYFEGSLGEDDNLDFSQNIVVDKEYLLEKISSLARSSERGYIHYIVQLQGDKISYEAACNLFAKTPYDSVLFQKNIEDSEIAYYYNPGDGEIQEIDKYKIPSIISDRPKIKLTFIGHGKDEFNTDIFAGFDVDSLSTEIEAAIDLAKEDISPKSIEINLLGCNMFSYSINVEETYPGKLLLKVKDKISELMPSISQDSIIVSANQYEVRINSEGRRELLDHSGEWINKEESIIKDISSKEYISFNPKENKITVKSKNLPELSTLLQEIRNNSNSSDIELEEKVMLTECEINVISNIDTQIVEERIEEAKNLTSDSINYIKDEFKLIESISDALCDLKQQNELEDSHFISFEDISETDEGFSIRFINKETGESIFVETEKTIFSEYANHITEEISKIKGTIFDTVNGKLVKKVNLDTTHEVNTLNAAFFIQSLIEYNSSKESLSNLSVAMKVQVYAQLFSTGLNTITDAAKVVELVSTALDETIDLLPTLSEGLPIIATIIDGVSLGAAIKELSETSDPLLRQEIEAKIGIMAVNLTTATTAIITSSLGIASGFSILLVPLAGISAGIPSLVNNELVLRDKATKVVDYFKHVSLVETEGVFTLLDDKIMMPQDDLVISEIDFNNNSIVLGKCEIWRMEGGSGHTVTDDIDHFFSAPSITYREPHLSIYDVLEVQKEELDLSKDLMVLPNAPNRVFAWETGWTPGLRSLENDGTKLLDRIRDNYEGEFYWRYFAFIADALITTLKPRYEDTNIRINLDSNTRSFIVPIITTEYIREKLSYSFYGSGGTYALSLSQYNMGINIELSESDVWIIDVDNVVRDVTIESDKIKKGDLIEGILSTLSIEENKIILNSHEINFSGEVNGSNGFVSLTFSILEGINAIIEVDLLSKSYKLLISGELKILMLNSNHIQQKIDYIGFNSELQKNIPYSFVDSEGKENGFINGSTKEGLFVSELPDVVLISKVYMDDSKPSFGYYSNNLKDVKVITKDNVNILTGYYLKDDIKISLSLTLQDEKTIKLNSVHLDESGVAEILKFMNRKGNTNTSDSLMSFLESMNIKSIFVNFLQSNIKFILDANFIISGTTSIGQFEFICDENDNIQPYFIKFNTLETNYTLYVGNRQNMIVEPNYDLDDSGDISSTVINFSQKYLYGIDSCVNKVVISPNIYTDEINITPVYETNNTYPEVIVLDANYINEKINVNINDLSIRYVWSNDGNDFILMSTSEENKVSQVKIRFVNVFKDKTLANKLSFNFSDKQDVPVSEIILSFTPSYYEDGLIGYDLGLVSLYNEKFYINNFGMMVSGLIYINDSLYYFKPPVNNLITGFVTVGDDKYYFNPINGGAASIGETIIDDKNYYFNQSGVLQTGVFSTEDGFKYFAPANTLDENLEGEAIDFTGKLIIDENIYYFDDNYRGAVEWKELDGEMHYFSPETGKAFKGLNQIGDYKYYFNSDGVMQKGFVSINDNKHYFDDSGVMKVGYTEIDGKHFYFAENGEMQIGVFNTEDGFKYFAHHNEDLGNEEGEEISYSGILNFNNKIYYFDDSFTAVVGWKDLEDGSKYYFDEDTAEAYIGLSLINDGQYYFNDDGIMQVGFVTINDKVFYFSDSGIIESGVQNIDDNYFYIDDNGIVQIGVFDTSDGYKYFAPANTVNDNIYGQAVEYSGLVRVGEDVYYFGETYTIETGWIYDMENESDKYYFNPETKKACKGINLIDDIKYYFDEKGIMRTGLISFENNNYYFNENGEMQFGYINIEDKMFYFGEDGVMQIGVFNTPDGFKYFAHQNTLDENFEGESINYTGWLDLDEKRYYFTDEYIAATGSVIIDGEEYYFDPDTAQLVISE

SEQ ID NO: 20 - protein, 2366 aa, Artificial Sequence
  VPI 10463 strain, TcdB (W102Del)
MGSLVNRKQLEKMANVRFRTQEDEYVAILDALEEYHNMSENTVVEKYLKLKDINSLTDIYIDTYKKSGRNKALKKFKEYLVTEVLELKNNNLTPVEKNLHFVIGGQINDTAINYINQWKDVNSDYNVNVFYDSNAFLINTLKKTVVESAINDTLESFRENLNDPRFDYNKFFRKRMEIIYDKQKNFINYYKAQREENPELIIDDIVKTYLSNEYSKEIDELNTYIEESLNKITQNSGNDVRNFEEFKNGESFNLYEQELVERWNLAAASDILRISALKEIGGMYLDVDMLPGIQPDLFESIEKPSSVTVDFWEMTKLEAIMKYKEYIPEYTSEHFDMLDEEVQSSFESVLASKSDKSEIFSSLGDMEASPLEVKIAFNSKGIINQGLISVKDSYCSNLIVKQIENRYKILNNSLNPAISEDNDFNTTTNTFIDSIMAEANADNGRFMMELGKYLRVGFFPDVKTTINLSGPEAYAAAYQDLLMFKEGSMNIHLIEADLRNFEISKTNISQSTEQEMASLWSFDDARAKAQFEEYKRNYFEGSLGEDDNLDFSQNIVVDKEYLLEKISSLARSSERGYIHYIVQLQGDKISYEAACNLFAKTPYDSVLFQKNIEDSEIAYYYNPGDGEIQEIDKYKIPSIISDRPKIKLTFIGHGKDEFNTDIFAGFDVDSLSTEIEAAIDLAKEDISPKSIEINLLGCNMFSYSINVEETYPGKLLLKVKDKISELMPSISQDSIIVSANQYEVRINSEGRRELLDHSGEWINKEESIIKDISSKEYISFNPKENKITVKSKNLPELSTLLQEIRNNSNSSDIELEEKVMLTECEINVISNIDTQIVEERIEEAKNLTSDSINYIKDEFKLIESISDALCDLKQQNELEDSHFISFEDISETDEGFSIRFINKETGESIFVETEKTIFSEYANHITEEISKIKGTIFDTVNGKLVKKVNLDTTHEVNTLNAAFFIQSLIEYNSSKESLSNLSVAMKVQVYAQLFSTGLNTITDAAKVVELVSTALDETIDLLPTLSEGLPIIATIIDGVSLGAAIKELSETSDPLLRQEIEAKIGIMAVNLTTATTAIITSSLGIASGFSILLVPLAGISAGIPSLVNNELVLRDKATKVVDYFKHVSLVETEGVFTLLDDKIMMPQDDLVISEIDFNNNSIVLGKCEIWRMEGGSGHTVTDDIDHFFSAPSITYREPHLSIYDVLEVQKEELDLSKDLMVLPNAPNRVFAWETGWTPGLRSLENDGTKLLDRIRDNYEGEFYWRYFAFIADALITTLKPRYEDTNIRINLDSNTRSFIVPIITTEYIREKLSYSFYGSGGTYALSLSQYNMGINIELSESDVWIIDVDNVVRDVTIESDKIKKGDLIEGILSTLSIEENKIILNSHEINFSGEVNGSNGFVSLTFSILEGINAIIEVDLLSKSYKLLISGELKILMLNSNHIQQKIDYIGFNSELQKNIPYSFVDSEGKENGFINGSTKEGLFVSELPDVVLISKVYMDDSKPSFGYYSNNLKDVKVITKDNVNILTGYYLKDDIKISLSLTLQDEKTIKLNSVHLDESGVAEILKFMNRKGNTNTSDSLMSFLESMNIKSIFVNFLQSNIKFILDANFIISGTTSIGQFEFICDENDNIQPYFIKFNTLETNYTLYVGNRQNMIVEPNYDLDDSGDISSTVINFSQKYLYGIDSCVNKVVISPNIYTDEINITPVYETNNTYPEVIVLDANYINEKINVNINDLSIRYVWSNDGNDFILMSTSEENKVSQVKIRFVNVFKDKTLANKLSFNFSDKQDVPVSEIILSFTPSYYEDGLIGYDLGLVSLYNEKFYINNFGMMVSGLIYINDSLYYFKPPVNNLITGFVTVGDDKYYFNPINGGAASIGETIIDDKNYYFNQSGVLQTGVFSTEDGFKYFAPANTLDENLEGEAIDFTGKLIIDENIYYFDDNYRGAVEWKELDGEMHYFSPETGKAFKGLNQIGDYKYYFNSDGVMQKGFVSINDNKHYFDDSGVMKVGYTEIDGKHFYFAENGEMQIGVFNTEDGFKYFAHHNEDLGNEEGEEISYSGILNFNNKIYYFDDSFTAVVGWKDLEDGSKYYFDEDTAEAYIGLSLINDGQYYFNDDGIMQVGFVTINDKVFYFSDSGIIESGVQNIDDNYFYIDDNGIVQIGVFDTSDGYKYFAPANTVNDNIYGQAVEYSGLVRVGEDVYYFGETYTIETGWIYDMENESDKYYFNPETKKACKGINLIDDIKYYFDEKGIMRTGLISFENNNYYFNENGEMQFGYINIEDKMFYFGEDGVMQIGVFNTPDGFKYFAHQNTLDENFEGESINYTGWLDLDEKRYYFTDEYIAATGSVIIDGEEYYFDPDTAQLVISE

SEQ ID NO: 21 - protein, 2366 aa, Artificial Sequence
  VPI 10463 strain, W102A, D288A, E515Q TcdB (Tri)
MSLVNRKQLEKMANVRFRTQEDEYVAILDALEEYHNMSENTVVEKYLKLKDINSLTDIYIDTYKKSGRNKALKKFKEYLVTEVLELKNNNLTPVEKNLHFVAIGGQINDTAINYINQWKDVNSDYNVNVFYDSNAFLINTLKKTVVESAINDTLESFRENLNDPRFDYNKFFRKRMEIIYDKQKNFINYYKAQREENPELIIDDIVKTYLSNEYSKEIDELNTYIEESLNKITQNSGNDVRNFEEFKNGESFNLYEQELVERWNLAAASDILRISALKEIGGMYLDVAMLPGIQPDLFESIEKPSSVTVDFWEMTKLEAIMKYKEYIPEYTSEHFDMLDEEVQSSFESVLASKSDKSEIFSSLGDMEASPLEVKIAFNSKGIINQGLISVKDSYCSNLIVKQIENRYKILNNSLNPAISEDNDFNTTTNTFIDSIMAEANADNGRFMMELGKYLRVGFFPDVKTTINLSGPEAYAAAYQDLLMFKEGSMNIHLIEADLRNFEISKTNISQSTEQQMASLWSFDDARAKAQFEEYKRNYFEGSLGEDDNLDFSQNIVVDKEYLLEKISSLARSSERGYIHYIVQLQGDKISYEAACNLFAKTPYDSVLFQKNIEDSEIAYYYNPGDGEIQEIDKYKIPSIISDRPKIKLTFIGHGKDEFNTDIFAGFDVDSLSTEIEAAIDLAKEDISPKSIEINLLGCNMFSYSINVEETYPGKLLLKVKDKISELMPSISQDSIIVSANQYEVRINSEGRRELLDHSGEWINKEESIIKDISSKEYISFNPKENKITVKSKNLPELSTLLQEIRNNSNSSDIELEEKVMLTECEINVISNIDTQIVEERIEEAKNLTSDSINYIKDEFKLIESISDALCDLKQQNELEDSHFISFEDISETDEGFSIRFINKETGESIFVETEKTIFSEYANHITEEISKIKGTIFDTVNGKLVKKVNLDTTHEVNTLNAAFFIQSLIEYNSSKESLSNLSVAMKVQVYAQLFSTGLNTITDAAKVVELVSTALDETIDLLPTLSEGLPIIATIIDGVSLGAAIKELSETSDPLLRQEIEAKIGIMAVNLTTATTAIITSSLGIASGFSILLVPLAGISAGIPSLVNNELVLRDKATKVVDYFKHVSLVETEGVFTLLDDKIMMPQDDLVISEIDFNNNSIVLGKCEIWRMEGGSGHTVTDDIDHFFSAPSITYREPHLSIYDVLEVQKEELDLSKDLMVLPNAPNRVFAWETGWTPGLRSLENDGTKLLDRIRDNYEGEFYWRYFAFIADALITTLKPRYEDTNIRINLDSNTRSFIVPIITTEYIREKLSYSFYGSGGTYALSLSQYNMGINIELSESDVWIIDVDNVVRDVTIESDKIKKGDLIEGILSTLSIEENKIILNSHEINFSGEVNGSNGFVSLTFSILEGINAIIEVDLLSKSYKLLISGELKILMLNSNHIQQKIDYIGFNSELQKNIPYSFVDSEGKENGFINGSTKEGLFVSELPDVVLISKVYMDDSKPSFGYYSNNLKDVKVITKDNVNILTGYYLKDDIKISLSLTLQDEKTIKLNSVHLDESGVAEILKFMNRKGNTNTSDSLMSFLESMNIKSIFVNFLQSNIKFILDANFIISGTTSIGQFEFICDENDNIQPYFIKFNTLETNYTLYVGNRQNMIVEPNYDLDDSGDISSTVINFSQKYLYGIDSCVNKVVISPNIYTDEINITPVYETNNTYPEVIVLDANYINEKINVNINDLSIRYVWSNDGNDFILMSTSEENKVSQVKIRFVNVFKDKTLANKLSFNFSDKQDVPVSEIILSFTPSYYEDGLIGYDLGLVSLYNEKFYINNFGMMVSGLIYINDSLYYFKPPVNNLITGFVTVGDDKYYFNPINGGAASIGETIIDDKNYYFNQSGVLQTGVFSTEDGFKYFAPANTLDENLEGEAIDFTGKLIIDENIYYFDDNYRGAVEWKELDGEMHYFSPETGKAFKGLNQIGDYKYYFNSDGVMQKGFVSINDNKHYFDDSGVMKVGYTEIDGKHFYFAENGEMQIGVFNTEDGFKYFAHHNEDLGNEEGEEISYSGILNFNNKIYYFDDSFTAVVGWKDLEDGSKYYFDEDTAEAYIGLSLINDGQYYFNDDGIMQVGFVTINDKVFYFSDSGIIESGVQNIDDNYFYIDDNGIVQIGVFDTSDGYKYFAPANTVNDNIYGQAVEYSGLVRVGEDVYYFGETYTIETGWIYDMENESDKYYFNPETKKACKGINLIDDIKYYFDEKGIMRTGLISFENNNYYFNENGEMQFGYINIEDKMFYFGEDGVMQIGVFNTPDGFKYFAHQNTLDENFEGESINYTGWLDLDEKRYYFTDEYIAATGSVIIDGEEYYFDPDTAQLVISE

SEQ ID NO: 22 - protein, 2366 aa, Artificial Sequence
  VPI 10463 strain  W102A, D286A, D288A, E515Q TcdB (Quad D286)
MSLVNRKQLEKMANVRFRTQEDEYVAILDALEEYHNMSENTVVEKYLKLKDINSLTDIYIDTYKKSGRNKALKKFKEYLVTEVLELKNNNLTPVEKNLHFVAIGGQINDTAINYINQWKDVNSDYNVNVFYDSNAFLINTLKKTVVESAINDTLESFRENLNDPRFDYNKFFRKRMEIIYDKQKNFINYYKAQREENPELIIDDIVKTYLSNEYSKEIDELNTYIEESLNKITQNSGNDVRNFEEFKNGESFNLYEQELVERWNLAAASDILRISALKEIGGMYLAVAMLPGIQPDLFESIEKPSSVTVDFWEMTKLEAIMKYKEYIPEYTSEHFDMLDEEVQSSFESVLASKSDKSEIFSSLGDMEASPLEVKIAFNSKGIINQGLISVKDSYCSNLIVKQIENRYKILNNSLNPAISEDNDFNTTTNTFIDSIMAEANADNGRFMMELGKYLRVGFFPDVKTTINLSGPEAYAAAYQDLLMFKEGSMNIHLIEADLRNFEISKTNISQSTEQQMASLWSFDDARAKAQFEEYKRNYFEGSLGEDDNLDFSQNIVVDKEYLLEKISSLARSSERGYIHYIVQLQGDKISYEAACNLFAKTPYDSVLFQKNIEDSEIAYYYNPGDGEIQEIDKYKIPSIISDRPKIKLTFIGHGKDEFNTDIFAGFDVDSLSTEIEAAIDLAKEDISPKSIEINLLGCNMFSYSINVEETYPGKLLLKVKDKISELMPSISQDSIIVSANQYEVRINSEGRRELLDHSGEWINKEESIIKDISSKEYISFNPKENKITVKSKNLPELSTLLQEIRNNSNSSDIELEEKVMLTECEINVISNIDTQIVEERIEEAKNLTSDSINYIKDEFKLIESISDALCDLKQQNELEDSHFISFEDISETDEGFSIRFINKETGESIFVETEKTIFSEYANHITEEISKIKGTIFDTVNGKLVKKVNLDTTHEVNTLNAAFFIQSLIEYNSSKESLSNLSVAMKVQVYAQLFSTGLNTITDAAKVVELVSTALDETIDLLPTLSEGLPIIATIIDGVSLGAAIKELSETSDPLLRQEIEAKIGIMAVNLTTATTAIITSSLGIASGFSILLVPLAGISAGIPSLVNNELVLRDKATKVVDYFKHVSLVETEGVFTLLDDKIMMPQDDLVISEIDFNNNSIVLGKCEIWRMEGGSGHTVTDDIDHFFSAPSITYREPHLSIYDVLEVQKEELDLSKDLMVLPNAPNRVFAWETGWTPGLRSLENDGTKLLDRIRDNYEGEFYWRYFAFIADALITTLKPRYEDTNIRINLDSNTRSFIVPIITTEYIREKLSYSFYGSGGTYALSLSQYNMGINIELSESDVWIIDVDNVVRDVTIESDKIKKGDLIEGILSTLSIEENKIILNSHEINFSGEVNGSNGFVSLTFSILEGINAIIEVDLLSKSYKLLISGELKILMLNSNHIQQKIDYIGFNSELQKNIPYSFVDSEGKENGFINGSTKEGLFVSELPDVVLISKVYMDDSKPSFGYYSNNLKDVKVITKDNVNILTGYYLKDDIKISLSLTLQDEKTIKLNSVHLDESGVAEILKFMNRKGNTNTSDSLMSFLESMNIKSIFVNFLQSNIKFILDANFIISGTTSIGQFEFICDENDNIQPYFIKFNTLETNYTLYVGNRQNMIVEPNYDLDDSGDISSTVINFSQKYLYGIDSCVNKVVISPNIYTDEINITPVYETNNTYPEVIVLDANYINEKINVNINDLSIRYVWSNDGNDFILMSTSEENKVSQVKIRFVNVFKDKTLANKLSFNFSDKQDVPVSEIILSFTPSYYEDGLIGYDLGLVSLYNEKFYINNFGMMVSGLIYINDSLYYFKPPVNNLITGFVTVGDDKYYFNPINGGAASIGETIIDDKNYYFNQSGVLQTGVFSTEDGFKYFAPANTLDENLEGEAIDFTGKLIIDENIYYFDDNYRGAVEWKELDGEMHYFSPETGKAFKGLNQIGDYKYYFNSDGVMQKGFVSINDNKHYFDDSGVMKVGYTEIDGKHFYFAENGEMQIGVFNTEDGFKYFAHHNEDLGNEEGEEISYSGILNFNNKIYYFDDSFTAVVGWKDLEDGSKYYFDEDTAEAYIGLSLINDGQYYFNDDGIMQVGFVTINDKVFYFSDSGIIESGVQNIDDNYFYIDDNGIVQIGVFDTSDGYKYFAPANTVNDNIYGQAVEYSGLVRVGEDVYYFGETYTIETGWIYDMENESDKYYFNPETKKACKGINLIDDIKYYFDEKGIMRTGLISFENNNYYFNENGEMQFGYINIEDKMFYFGEDGVMQIGVFNTPDGFKYFAHQNTLDENFEGESINYTGWLDLDEKRYYFTDEYIAATGSVIIDGEEYYFDPDTAQLVISE

SEQ ID NO: 23 - protein, 2366 aa, Artificial Sequence
  VPI 10463 strain, W102A, D288A, E515Q, S518A TcdB (Quad S518)
MSLVNRKQLEKMANVRFRTQEDEYVAILDALEEYHNMSENTVVEKYLKLKDINSLTDIYIDTYKKSGRNKALKKFKEYLVTEVLELKNNNLTPVEKNLHFVAIGGQINDTAINYINQWKDVNSDYNVNVFYDSNAFLINTLKKTVVESAINDTLESFRENLNDPRFDYNKFFRKRMEIIYDKQKNFINYYKAQREENPELIIDDIVKTYLSNEYSKEIDELNTYIEESLNKITQNSGNDVRNFEEFKNGESFNLYEQELVERWNLAAASDILRISALKEIGGMYLDVAMLPGIQPDLFESIEKPSSVTVDFWEMTKLEAIMKYKEYIPEYTSEHFDMLDEEVQSSFESVLASKSDKSEIFSSLGDMEASPLEVKIAFNSKGIINQGLISVKDSYCSNLIVKQIENRYKILNNSLNPAISEDNDFNTTTNTFIDSIMAEANADNGRFMMELGKYLRVGFFPDVKTTINLSGPEAYAAAYQDLLMFKEGSMNIHLIEADLRNFEISKTNISQSTEQQMAALWSFDDARAKAQFEEYKRNYFEGSLGEDDNLDFSQNIVVDKEYLLEKISSLARSSERGYIHYIVQLQGDKISYEAACNLFAKTPYDSVLFQKNIEDSEIAYYYNPGDGEIQEIDKYKIPSIISDRPKIKLTFIGHGKDEFNTDIFAGFDVDSLSTEIEAAIDLAKEDISPKSIEINLLGCNMFSYSINVEETYPGKLLLKVKDKISELMPSISQDSIIVSANQYEVRINSEGRRELLDHSGEWINKEESIIKDISSKEYISFNPKENKITVKSKNLPELSTLLQEIRNNSNSSDIELEEKVMLTECEINVISNIDTQIVEERIEEAKNLTSDSINYIKDEFKLIESISDALCDLKQQNELEDSHFISFEDISETDEGFSIRFINKETGESIFVETEKTIFSEYANHITEEISKIKGTIFDTVNGKLVKKVNLDTTHEVNTLNAAFFIQSLIEYNSSKESLSNLSVAMKVQVYAQLFSTGLNTITDAAKVVELVSTALDETIDLLPTLSEGLPIIATIIDGVSLGAAIKELSETSDPLLRQEIEAKIGIMAVNLTTATTAIITSSLGIASGFSILLVPLAGISAGIPSLVNNELVLRDKATKVVDYFKHVSLVETEGVFTLLDDKIMMPQDDLVISEIDFNNNSIVLGKCEIWRMEGGSGHTVTDDIDHFFSAPSITYREPHLSIYDVLEVQKEELDLSKDLMVLPNAPNRVFAWETGWTPGLRSLENDGTKLLDRIRDNYEGEFYWRYFAFIADALITTLKPRYEDTNIRINLDSNTRSFIVPIITTEYIREKLSYSFYGSGGTYALSLSQYNMGINIELSESDVWIIDVDNVVRDVTIESDKIKKGDLIEGILSTLSIEENKIILNSHEINFSGEVNGSNGFVSLTFSILEGINAIIEVDLLSKSYKLLISGELKILMLNSNHIQQKIDYIGFNSELQKNIPYSFVDSEGKENGFINGSTKEGLFVSELPDVVLISKVYMDDSKPSFGYYSNNLKDVKVITKDNVNILTGYYLKDDIKISLSLTLQDEKTIKLNSVHLDESGVAEILKFMNRKGNTNTSDSLMSFLESMNIKSIFVNFLQSNIKFILDANFIISGTTSIGQFEFICDENDNIQPYFIKFNTLETNYTLYVGNRQNMIVEPNYDLDDSGDISSTVINFSQKYLYGIDSCVNKVVISPNIYTDEINITPVYETNNTYPEVIVLDANYINEKINVNINDLSIRYVWSNDGNDFILMSTSEENKVSQVKIRFVNVFKDKTLANKLSFNFSDKQDVPVSEIILSFTPSYYEDGLIGYDLGLVSLYNEKFYINNFGMMVSGLIYINDSLYYFKPPVNNLITGFVTVGDDKYYFNPINGGAASIGETIIDDKNYYFNQSGVLQTGVFSTEDGFKYFAPANTLDENLEGEAIDFTGKLIIDENIYYFDDNYRGAVEWKELDGEMHYFSPETGKAFKGLNQIGDYKYYFNSDGVMQKGFVSINDNKHYFDDSGVMKVGYTEIDGKHFYFAENGEMQIGVFNTEDGFKYFAHHNEDLGNEEGEEISYSGILNFNNKIYYFDDSFTAVVGWKDLEDGSKYYFDEDTAEAYIGLSLINDGQYYFNDDGIMQVGFVTINDKVFYFSDSGIIESGVQNIDDNYFYIDDNGIVQIGVFDTSDGYKYFAPANTVNDNIYGQAVEYSGLVRVGEDVYYFGETYTIETGWIYDMENESDKYYFNPETKKACKGINLIDDIKYYFDEKGIMRTGLISFENNNYYFNENGEMQFGYINIEDKMFYFGEDGVMQIGVFNTPDGFKYFAHQNTLDENFEGESINYTGWLDLDEKRYYFTDEYIAATGSVIIDGEEYYFDPDTAQLVISE

SEQ ID NO: 24 - protein, 2366 aa, Artificial Sequence
  VPI 10463 strain, W102A, D288A, E515Q, W520A TcdB (Quad W520)
MSLVNRKQLEKMANVRFRTQEDEYVAILDALEEYHNMSENTVVEKYLKLKDINSLTDIYIDTYKKSGRNKALKKFKEYLVTEVLELKNNNLTPVEKNLHFVAIGGQINDTAINYINQWKDVNSDYNVNVFYDSNAFLINTLKKTVVESAINDTLESFRENLNDPRFDYNKFFRKRMEIIYDKQKNFINYYKAQREENPELIIDDIVKTYLSNEYSKEIDELNTYIEESLNKITQNSGNDVRNFEEFKNGESFNLYEQELVERWNLAAASDILRISALKEIGGMYLDVAMLPGIQPDLFESIEKPSSVTVDFWEMTKLEAIMKYKEYIPEYTSEHFDMLDEEVQSSFESVLASKSDKSEIFSSLGDMEASPLEVKIAFNSKGIINQGLISVKDSYCSNLIVKQIENRYKILNNSLNPAISEDNDFNTTTNTFIDSIMAEANADNGRFMMELGKYLRVGFFPDVKTTINLSGPEAYAAAYQDLLMFKEGSMNIHLIEADLRNFEISKTNISQSTEQQMASLASFDDARAKAQFEEYKRNYFEGSLGEDDNLDFSQNIVVDKEYLLEKISSLARSSERGYIHYIVQLQGDKISYEAACNLFAKTPYDSVLFQKNIEDSEIAYYYNPGDGEIQEIDKYKIPSIISDRPKIKLTFIGHGKDEFNTDIFAGFDVDSLSTEIEAAIDLAKEDISPKSIEINLLGCNMFSYSINVEETYPGKLLLKVKDKISELMPSISQDSIIVSANQYEVRINSEGRRELLDHSGEWINKEESIIKDISSKEYISFNPKENKITVKSKNLPELSTLLQEIRNNSNSSDIELEEKVMLTECEINVISNIDTQIVEERIEEAKNLTSDSINYIKDEFKLIESISDALCDLKQQNELEDSHFISFEDISETDEGFSIRFINKETGESIFVETEKTIFSEYANHITEEISKIKGTIFDTVNGKLVKKVNLDTTHEVNTLNAAFFIQSLIEYNSSKESLSNLSVAMKVQVYAQLFSTGLNTITDAAKVVELVSTALDETIDLLPTLSEGLPIIATIIDGVSLGAAIKELSETSDPLLRQEIEAKIGIMAVNLTTATTAIITSSLGIASGFSILLVPLAGISAGIPSLVNNELVLRDKATKVVDYFKHVSLVETEGVFTLLDDKIMMPQDDLVISEIDFNNNSIVLGKCEIWRMEGGSGHTVTDDIDHFFSAPSITYREPHLSIYDVLEVQKEELDLSKDLMVLPNAPNRVFAWETGWTPGLRSLENDGTKLLDRIRDNYEGEFYWRYFAFIADALITTLKPRYEDTNIRINLDSNTRSFIVPIITTEYIREKLSYSFYGSGGTYALSLSQYNMGINIELSESDVWIIDVDNVVRDVTIESDKIKKGDLIEGILSTLSIEENKIILNSHEINFSGEVNGSNGFVSLTFSILEGINAIIEVDLLSKSYKLLISGELKILMLNSNHIQQKIDYIGFNSELQKNIPYSFVDSEGKENGFINGSTKEGLFVSELPDVVLISKVYMDDSKPSFGYYSNNLKDVKVITKDNVNILTGYYLKDDIKISLSLTLQDEKTIKLNSVHLDESGVAEILKFMNRKGNTNTSDSLMSFLESMNIKSIFVNFLQSNIKFILDANFIISGTTSIGQFEFICDENDNIQPYFIKFNTLETNYTLYVGNRQNMIVEPNYDLDDSGDISSTVINFSQKYLYGIDSCVNKVVISPNIYTDEINITPVYETNNTYPEVIVLDANYINEKINVNINDLSIRYVWSNDGNDFILMSTSEENKVSQVKIRFVNVFKDKTLANKLSFNFSDKQDVPVSEIILSFTPSYYEDGLIGYDLGLVSLYNEKFYINNFGMMVSGLIYINDSLYYFKPPVNNLITGFVTVGDDKYYFNPINGGAASIGETIIDDKNYYFNQSGVLQTGVFSTEDGFKYFAPANTLDENLEGEAIDFTGKLIIDENIYYFDDNYRGAVEWKELDGEMHYFSPETGKAFKGLNQIGDYKYYFNSDGVMQKGFVSINDNKHYFDDSGVMKVGYTEIDGKHFYFAENGEMQIGVFNTEDGFKYFAHHNEDLGNEEGEEISYSGILNFNNKIYYFDDSFTAVVGWKDLEDGSKYYFDEDTAEAYIGLSLINDGQYYFNDDGIMQVGFVTINDKVFYFSDSGIIESGVQNIDDNYFYIDDNGIVQIGVFDTSDGYKYFAPANTVNDNIYGQAVEYSGLVRVGEDVYYFGETYTIETGWIYDMENESDKYYFNPETKKACKGINLIDDIKYYFDEKGIMRTGLISFENNNYYFNENGEMQFGYINIEDKMFYFGEDGVMQIGVFNTPDGFKYFAHQNTLDENFEGESINYTGWLDLDEKRYYFTDEYIAATGSVIIDGEEYYFDPDTAQLVISE

SEQ ID NO: 25 - protein, 2710 aa, Artificial Sequence
  Nap strain, 3mTcdA (W101A, D287A, E514Q)
MSLISKEELIKLAYSIRPRENEYKTILTNLDEYNKLTTNNNENKYLQLKKLNESIDVFMNKYKNSSRNRALSNLKKDILKEVILIKNSNTSPVEKNLHFVAIGGEVSDIALEYIKQWADINAEYNIKLWYDSEAFLVNTLKKAIVESSTTEALQLLEEEIQNPQFDNMKFYKKRMEFIYDRQKRFINYYKSQINKPTVPTIDDIIKSHLVSEYNRDETLLESYRTNSLRKINSNHGIDIRANSLFTEQELLNIYSQELLNRGNLAAASDIVRLLALKNFGGVYLDVAMLPGIHSDLFKTIPRPSSIGLDRWEMIKLEAIMKYKKYINNYTSENFDKLDQQLKDNFKLIIESKSEKSEIFSKLENLNVSDLEIKIAFALGSVINQALISKQGSYLTNLVIEQVKNRYQFLNQHLNPAIESDNNFTDTTKIFHDSLFNSATAENSMFLTKIAPYLQVGFMPEARSTISLSGPGAYASAYYDFINLQENTIEKTLKASDLIEFKFPENNLSQLTEQQINSLWSFDQASAKYQFEKYVRDYTGGSLSEDNGVDFNKNTALDKNYLLNNKIPSNNVEEAGSKNYVHYIIQLQGDDISYEATCNLFSKNPKNSIIIQRNMNESAKSYFLSDDGESILELNKYRIPERLKNKEKVKVTFIGHGKDEFNTSEFARLSVDSLSNEISSFLDTIKLDISPKNVEVNLLGCNMFSYDFNVEETYPGKLLLSIMDKITSTLPDVNKDSITIGANQYEVRINSEGRKELLAHSGKWINKEEAIMSDLSSKEYIFFDSIDNKLKAKSKNIPGLASISEDIKTLLLDASVSPDTKFILNNLKLNIESSIGDYIYYEKLEPVKNIIHNSIDDLIDEFNLLENVSDELYELKKLNNLDEKYLISFEDISKNNSTYSVRFINKSNGESVYVETEKEIFSKYSEHITKEISTIKNSIITDVNGNLLDNIQLDHTSQVNTLNAAFFIQSLIDYSSNKDVLNDLSTSVKVQLYAQLFSTGLNTIYDSIQLVNLISNAVNDTINVLPTITEGIPIVSTILDGINLGAAIKELLDEHDPLLKKELEAKVGVLAINMSLSIAATVASIVGIGAEVTIFLLPIAGISAGIPSLVNNELILHDKATSVVNYFNHLSESKEYGPLKTEDDKILVPIDDLVISEIDFNNNSIKLGTCNILAMEGGSGHTVTGNIDHFFSSPYISSHIPSLSVYSAIGIKTENLDFSKKIMMLPNAPSRVFWWETGAVPGLRSLENNGTKLLDSIRDLYPGKFYWRFYAFFDYAITTLKPVYEDTNTKIKLDKDTRNFIMPTITTDEIRNKLSYSFDGAGGTYSLLLSSYPISMNINLSKDDLWIFNIDNEVREISIENGTIKKGNLIEDVLSKIDINKNKLIIGNQTIDFSGDIDNKDRYIFLTCELDDKISLIIEINLVAKSYSLLLSGDKNYLISNLSNTIEKINTLGLDSKNIAYNYTDESNNKYFGAISKTSQKSIIHYKKDSKNILEFYNGSTLEFNSKDFIAEDINVFMKDDINTITGKYYVDNNTDKSIDFSISLVSKNQVKVNGLYLNESVYSSYLDFVKNSDGHHNTSNFMNLFLNNISFWKLFGFENINFVIDKYFTLVGKTNLGYVEFICDNNKNIDIYFGEWKTSSSKSTIFSGNGRNVVVEPIYNPDTGEDISTSLDFSYEPLYGIDRYINKVLIAPDLYTSLININTNYYSNEYYPEIIVLNPNTFHKKVNINLDSSSFEYKWSTEGSDFILVRYLEESNKKILQKIRIKGILSNTQSFNKMSIDFKDIKKLSLGYIMSNFKSFNSENELDRDHLGFKIIDNKTYYYDEDSKLVKGLININNSLFYFDPIESNLVTGWQTINGKKYYFDINTGAASTSYKIINGKHFYFNNNGVMQLGVFKGPDGFEYFAPANTQNNNIEGQAIVYQSKFLTLNGKKYYFDNDSKAVTGWRIINNEKYYFNPNNAIAAVGLQVIDNNKYYFNPDTAIISKGWQTVNGSRYYFDTDTAIAFNGYKTIDGKHFYFDSDCVVKIGVFSGSNGFEYFAPANTYNNNIEGQAIVYQSKFLTLNGKKYYFDNNSKAVTGWQTIDSKKYYFNTNTAEAATGWQTIDGKKYYFNTNTAEAATGWQTIDGKKYYFNTNTSIASTGYTIINGKYFYFNTDGIMQIGVFKVPNGFEYFAPANTHNNNIEGQAILYQNKFLTLNGKKYYFGSDSKAITGWQTIDGKKYYFNPNNAIAATHLCTINNDKYYFSYDGILQNGYITIERNNFYFDANNESKMVTGVFKGPNGFEYFAPANTHNNNIEGQAIVYQNKFLTLNGKKYYFDNDSKAVTGWQTIDSKKYYFNLNTAVAVTGWQTIDGEKYYFNLNTAEAATGWQTIDGKRYYFNTNTYIASTGYTIINGKHFYFNTDGIMQIGVFKGPDGFEYFAPANTHNNNIEGQAILYQNKFLTLNGKKYYFGSDSKAVTGLRTIDGKKYYFNTNTAVAVTGWQTINGKKYYFNTNTYIASTGYTIISGKHFYFNTDGIMQIGVFKGPDGFEYFAPANTDANNIEGQAIRYQNRFLYLHDNIYYFGNDSKAATGWATIDGNRYYFEPNTAMGANGYKTIDNKNFYFRNGLPQIGVFKGPNGFEYFAPANTDANNIDGQAIRYQNRFLHLLGKIYYFGNNSKAVTGWQTINSKVYYFMPDTAMAAAGGLFEIDGVIYFFGVDGVKAPGIYG

SEQ ID NO: 26 - protein, 2710 aa, Artificial Sequence
  VPI 10463 strain, 5mTcdA (W101A, D287A, E514Q, W519A, C700A)
MSLISKEELIKLAYSIRPRENEYKTILTNLDEYNKLTTNNNENKYLQLKKLNESIDVFMNKYKTSSRNRALSNLKKDILKEVILIKNSNTSPVEKNLHFVAIGGEVSDIALEYIKQWADINAEYNIKLWYDSEAFLVNTLKKAIVESSTTEALQLLEEEIQNPQFDNMKFYKKRMEFIYDRQKRFINYYKSQINKPTVPTIDDIIKSHLVSEYNRDETVLESYRTNSLRKINSNHGIDIRANSLFTEQELLNIYSQELLNRGNLAAASDIVRLLALKNFGGVYLDVAMLPGIHSDLFKTISRPSSIGLDRWEMIKLEAIMKYKKYINNYTSENFDKLDQQLKDNFKLIIESKSEKSEIFSKLENLNVSDLEIKIAFALGSVINQALISKQGSYLTNLVIEQVKNRYQFLNQHLNPAIESDNNFTDTTKIFHDSLFNSATAENSMFLTKIAPYLQVGFMPEARSTISLSGPGAYASAYYDFINLQENTIEKTLKASDLIEFKFPENNLSQLTEQQINSLASFDQASAKYQFEKYVRDYTGGSLSEDNGVDFNKNTALDKNYLLNNKIPSNNVEEAGSKNYVHYIIQLQGDDISYEATCNLFSKNPKNSIIIQRNMNESAKSYFLSDDGESILELNKYRIPERLKNKEKVKVTFIGHGKDEFNTSEFARLSVDSLSNEISSFLDTIKLDISPKNVEVNLLGANMFSYDFNVEETYPGKLLLSIMDKITSTLPDVNKNSITIGANQYEVRINSEGRKELLAHSGKWINKEEAIMSDLSSKEYIFFDSIDNKLKAKSKNIPGLASISEDIKTLLLDASVSPDTKFILNNLKLNIESSIGDYIYYEKLEPVKNIIHNSIDDLIDEFNLLENVSDELYELKKLNNLDEKYLISFEDISKNNSTYSVRFINKSNGESVYVETEKEIFSKYSEHITKEISTIKNSIITDVNGNLLDNIQLDHTSQVNTLNAAFFIQSLIDYSSNKDVLNDLSTSVKVQLYAQLFSTGLNTIYDSIQLVNLISNAVNDTINVLPTITEGIPIVSTILDGINLGAAIKELLDEHDPLLKKELEAKVGVLAINMSLSIAATVASIVGIGAEVTIFLLPIAGISAGIPSLVNNELILHDKATSVVNYFNHLSESKKYGPLKTEDDKILVPIDDLVISEIDFNNNSIKLGTCNILAMEGGSGHTVTGNIDHFFSSPSISSHIPSLSIYSAIGIETENLDFSKKIMMLPNAPSRVFWWETGAVPGLRSLENDGTRLLDSIRDLYPGKFYWRFYAFFDYAITTLKPVYEDTNIKIKLDKDTRNFIMPTITTNEIRNKLSYSFDGAGGTYSLLLSSYPISTNINLSKDDLWIFNIDNEVREISIENGTIKKGKLIKDVLSKIDINKNKLIIGNQTIDFSGDIDNKDRYIFLTCELDDKISLIIEINLVAKSYSLLLSGDKNYLISNLSNTIEKINTLGLDSKNIAYNYTDESNNKYFGAISKTSQKSIIHYKKDSKNILEFYNDSTLEFNSKDFIAEDINVFMKDDINTITGKYYVDNNTDKSIDFSISLVSKNQVKVNGLYLNESVYSSYLDFVKNSDGHHNTSNFMNLFLDNISFWKLFGFENINFVIDKYFTLVGKTNLGYVEFICDNNKNIDIYFGEWKTSSSKSTIFSGNGRNVVVEPIYNPDTGEDISTSLDFSYEPLYGIDRYINKVLIAPDLYTSLININTNYYSNEYYPEIIVLNPNTFHKKVNINLDSSSFEYKWSTEGSDFILVRYLEESNKKILQKIRIKGILSNTQSFNKMSIDFKDIKKLSLGYIMSNFKSFNSENELDRDHLGFKIIDNKTYYYDEDSKLVKGLININNSLFYFDPIEFNLVTGWQTINGKKYYFDINTGAALTSYKIINGKHFYFNNDGVMQLGVFKGPDGFEYFAPANTQNNNIEGQAIVYQSKFLTLNGKKYYFDNNSKAVTGWRIINNEKYYFNPNNAIAAVGLQVIDNNKYYFNPDTAIISKGWQTVNGSRYYFDTDTAIAFNGYKTIDGKHFYFDSDCVVKIGVFSTSNGFEYFAPANTYNNNIEGQAIVYQSKFLTLNGKKYYFDNNSKAVTGLQTIDSKKYYFNTNTAEAATGWQTIDGKKYYFNTNTAEAATGWQTIDGKKYYFNTNTAIASTGYTIINGKHFYFNTDGIMQIGVFKGPNGFEYFAPANTDANNIEGQAILYQNEFLTLNGKKYYFGSDSKAVTGWRIINNKKYYFNPNNAIAAIHLCTINNDKYYFSYDGILQNGYITIERNNFYFDANNESKMVTGVFKGPNGFEYFAPANTHNNNIEGQAIVYQNKFLTLNGKKYYFDNDSKAVTGWQTIDGKKYYFNLNTAEAATGWQTIDGKKYYFNLNTAEAATGWQTIDGKKYYFNTNTFIASTGYTSINGKHFYFNTDGIMQIGVFKGPNGFEYFAPANTDANNIEGQAILYQNKFLTLNGKKYYFGSDSKAVTGLRTIDGKKYYFNTNTAVAVTGWQTINGKKYYFNTNTSIASTGYTIISGKHFYFNTDGIMQIGVFKGPDGFEYFAPANTDANNIEGQAIRYQNRFLYLHDNIYYFGNNSKAATGWVTIDGNRYYFEPNTAMGANGYKTIDNKNFYFRNGLPQIGVFKGSNGFEYFAPANTDANNIEGQAIRYQNRFLHLLGKIYYFGNNSKAVTGWQTINGKVYYFMPDTAMAAAGGLFEIDGVIYFFGVDGVKAPGIYG

SEQ ID NO: 27 - protein, 2366 aa, Artificial Sequence
  Nap strain, 3mTcdB (W102A, D288A, E515Q)
MSLVNRKQLEKMANVRFRVQEDEYVAILDALEEYHNMSENTVVEKYLKLKDINSLTDIYIDTYKKSGRNKALKKFKEYLVTEVLELKNNNLTPVEKNLHFVAIGGQINDTAINYINQWKDVNSDYNVNVFYDSNAFLINTLKKTIVESATNDTLESFRENLNDPRFDYNKFYRKRMEIIYDKQKNFINYYKTQREENPDLIIDDIVKIYLSNEYSKDIDELNSYIEESLNKVTENSGNDVRNFEEFKGGESFKLYEQELVERWNLAAASDILRISALKEVGGVYLDVAMLPGIQPDLFESIEKPSSVTVDFWEMVKLEAIMKYKEYIPGYTSEHFDMLDEEVQSSFESVLASKSDKSEIFSSLGDMEASPLEVKIAFNSKGIINQGLISVKDSYCSNLIVKQIENRYKILNNSLNPAISEDNDFNTTTNAFIDSIMAEANADNGRFMMELGKYLRVGFFPDVKTTINLSGPEAYAAAYQDLLMFKEGSMNIHLIEADLRNFEISKTNISQSTEQQMASLWSFDDARAKAQFEEYKKNYFEGSLGEDDNLDFSQNTVVDKEYLLEKISSLARSSERGYIHYIVQLQGDKISYEAACNLFAKTPYDSVLFQKNIEDSEIAYYYNPGDGEIQEIDKYKIPSIISDRPKIKLTFIGHGKDEFNTDIFAGLDVDSLSTEIETAIDLAKEDISPKSIEINLLGCNMFSYSVNVEETYPGKLLLRVKDKVSELMPSISQDSIIVSANQYEVRINSEGRRELLDHSGEWINKEESIIKDISSKEYISFNPKENKIIVKSKNLPELSTLLQEIRNNSNSSDIELEEKVMLAECEINVISNIDTQVVEGRIEEAKSLTSDSINYIKNEFKLIESISDALYDLKQQNELEESHFISFEDILETDEGFSIRFIDKETGESIFVETEKAIFSEYANHITEEISKIKGTIFDTVNGKLVKKVNLDATHEVNTLNAAFFIQSLIEYNSSKESLSNLSVAMKVQVYAQLFSTGLNTITDAAKVVELVSTALDETIDLLPTLSEGLPVIATIIDGVSLGAAIKELSETSDPLLRQEIEAKIGIMAVNLTAATTAIITSSLGIASGFSILLVPLAGISAGIPSLVNNELILRDKATKVVDYFSHISLAESEGAFTSLDDKIMMPQDDLVISEIDFNNNSITLGKCEIWRMEGGSGHTVTDDIDHFFSAPSITYREPHLSIYDVLEVQKEELDLSKDLMVLPNAPNRVFAWETGWTPGLRSLENDGTKLLDRIRDNYEGEFYWRYFAFIADALITTLKPRYEDTNIRINLDSNTRSFIVPVITTEYIREKLSYSFYGSGGTYALSLSQYNMNINIELNENDTWVIDVDNVVRDVTIESDKIKKGDLIENILSKLSIEDNKIILDNHEINFSGTLNGGNGFVSLTFSILEGINAVIEVDLLSKSYKVLISGELKTLMANSNSVQQKIDYIGLNSELQKNIPYSFMDDKGKENGFINCSTKEGLFVSELSDVVLISKVYMDNSKPLFGYCSNDLKDVKVITKDDVIILTGYYLKDDIKISLSFTIQDENTIKLNGVYLDENGVAEILKFMNKKGSTNTSDSLMSFLESMNIKSIFINSLQSNTKLILDTNFIISGTTSIGQFEFICDKDNNIQPYFIKFNTLETKYTLYVGNRQNMIVEPNYDLDDSGDISSTVINFSQKYLYGIDSCVNKVIISPNIYTDEINITPIYEANNTYPEVIVLDTNYISEKINININDLSIRYVWSNDGSDFILMSTDEENKVSQVKIRFTNVFKGNTISDKISFNFSDKQDVSINKVISTFTPSYYVEGLLNYDLGLISLYNEKFYINNFGMMVSGLVYINDSLYYFKPPIKNLITGFTTIGDDKYYFNPDNGGAASVGETIIDGKNYYFSQNGVLQTGVFSTEDGFKYFAPADTLDENLEGEAIDFTGKLTIDENVYYFGDNYRAAIEWQTLDDEVYYFSTDTGRAFKGLNQIGDDKFYFNSDGIMQKGFVNINDKTFYFDDSGVMKSGYTEIDGKYFYFAENGEMQIGVFNTADGFKYFAHHDEDLGNEEGEALSYSGILNFNNKIYYFDDSFTAVVGWKDLEDGSKYYFDEDTAEAYIGISIINDGKYYFNDSGIMQIGFVTINNEVFYFSDSGIVESGMQNIDDNYFYIDENGLVQIGVFDTSDGYKYFAPANTVNDNIYGQAVEYSGLVRVGEDVYYFGETYTIETGWIYDMENESDKYYFDPETKKAYKGINVIDDIKYYFDENGIMRTGLITFEDNHYYFNEDGIMQYGYLNIEDKTFYFSEDGIMQIGVFNTPDGFKYFAHQNTLDENFEGESINYTGWLDLDEKRYYFTDEYIAATGSVIIDGEEYYFDPDTAQLVISE

SEQ ID NO: 28 - protein, 2366 aa, Artificial Sequence
  Nap strain, 5mTcdB, (W102A, D288A, E515Q, W520A, C698A)
MSLVNRKQLEKMANVRFRVQEDEYVAILDALEEYHNMSENTVVEKYLKLKDINSLTDIYIDTYKKSGRNKALKKFKEYLVTEVLELKNNNLTPVEKNLHFVAIGGQINDTAINYINQWKDVNSDYNVNVFYDSNAFLINTLKKTIVESATNDTLESFRENLNDPRFDYNKFYRKRMEIIYDKQKNFINYYKTQREENPDLIIDDIVKIYLSNEYSKDIDELNSYIEESLNKVTENSGNDVRNFEEFKGGESFKLYEQELVERWNLAAASDILRISALKEVGGVYLDVAMLPGIQPDLFESIEKPSSVTVDFWEMVKLEAIMKYKEYIPGYTSEHFDMLDEEVQSSFESVLASKSDKSEIFSSLGDMEASPLEVKIAFNSKGIINQGLISVKDSYCSNLIVKQIENRYKILNNSLNPAISEDNDFNTTTNAFIDSIMAEANADNGRFMMELGKYLRVGFFPDVKTTINLSGPEAYAAAYQDLLMFKEGSMNIHLIEADLRNFEISKTNISQSTEQQMASLASFDDARAKAQFEEYKKNYFEGSLGEDDNLDFSQNTVVDKEYLLEKISSLARSSERGYIHYIVQLQGDKISYEAACNLFAKTPYDSVLFQKNIEDSEIAYYYNPGDGEIQEIDKYKIPSIISDRPKIKLTFIGHGKDEFNTDIFAGLDVDSLSTEIETAIDLAKEDISPKSIEINLLGANMFSYSVNVEETYPGKLLLRVKDKVSELMPSISQDSIIVSANQYEVRINSEGRRELLDHSGEWINKEESIIKDISSKEYISFNPKENKIIVKSKNLPELSTLLQEIRNNSNSSDIELEEKVMLAECEINVISNIDTQVVEGRIEEAKSLTSDSINYIKNEFKLIESISDALYDLKQQNELEESHFISFEDILETDEGFSIRFIDKETGESIFVETEKAIFSEYANHITEEISKIKGTIFDTVNGKLVKKVNLDATHEVNTLNAAFFIQSLIEYNSSKESLSNLSVAMKVQVYAQLFSTGLNTITDAAKVVELVSTALDETIDLLPTLSEGLPVIATIIDGVSLGAAIKELSETSDPLLRQEIEAKIGIMAVNLTAATTAIITSSLGIASGFSILLVPLAGISAGIPSLVNNELILRDKATKVVDYFSHISLAESEGAFTSLDDKIMMPQDDLVISEIDFNNNSITLGKCEIWRMEGGSGHTVTDDIDHFFSAPSITYREPHLSIYDVLEVQKEELDLSKDLMVLPNAPNRVFAWETGWTPGLRSLENDGTKLLDRIRDNYEGEFYWRYFAFIADALITTLKPRYEDTNIRINLDSNTRSFIVPVITTEYIREKLSYSFYGSGGTYALSLSQYNMNINIELNENDTWVIDVDNVVRDVTIESDKIKKGDLIENILSKLSIEDNKIILDNHEINFSGTLNGGNGFVSLTFSILEGINAVIEVDLLSKSYKVLISGELKTLMANSNSVQQKIDYIGLNSELQKNIPYSFMDDKGKENGFINCSTKEGLFVSELSDVVLISKVYMDNSKPLFGYCSNDLKDVKVITKDDVIILTGYYLKDDIKISLSFTIQDENTIKLNGVYLDENGVAEILKFMNKKGSTNTSDSLMSFLESMNIKSIFINSLQSNTKLILDTNFIISGTTSIGQFEFICDKDNNIQPYFIKFNTLETKYTLYVGNRQNMIVEPNYDLDDSGDISSTVINFSQKYLYGIDSCVNKVIISPNIYTDEINITPIYEANNTYPEVIVLDTNYISEKINININDLSIRYVWSNDGSDFILMSTDEENKVSQVKIRFTNVFKGNTISDKISFNFSDKQDVSINKVISTFTPSYYVEGLLNYDLGLISLYNEKFYINNFGMMVSGLVYINDSLYYFKPPIKNLITGFTTIGDDKYYFNPDNGGAASVGETIIDGKNYYFSQNGVLQTGVFSTEDGFKYFAPADTLDENLEGEAIDFTGKLTIDENVYYFGDNYRAAIEWQTLDDEVYYFSTDTGRAFKGLNQIGDDKFYFNSDGIMQKGFVNINDKTFYFDDSGVMKSGYTEIDGKYFYFAENGEMQIGVFNTADGFKYFAHHDEDLGNEEGEALSYSGILNFNNKIYYFDDSFTAVVGWKDLEDGSKYYFDEDTAEAYIGISIINDGKYYFNDSGIMQIGFVTINNEVFYFSDSGIVESGMQNIDDNYFYIDENGLVQIGVFDTSDGYKYFAPANTVNDNIYGQAVEYSGLVRVGEDVYYFGETYTIETGWIYDMENESDKYYFDPETKKAYKGINVIDDIKYYFDENGIMRTGLITFEDNHYYFNEDGIMQYGYLNIEDKTFYFSEDGIMQIGVFNTPDGFKYFAHQNTLDENFEGESINYTGWLDLDEKRYYFTDEYIAATGSVIIDGEEYYFDPDTAQLVISE

SEQ ID NO: 29 - DNA, 8130 bp, Artificial Sequence
  Nap strain, 3mTcdA, bacillus megaterium optimized (W101A, D287A, E514Q)
atgtctcttatttctaaagaagaacttattaagttggcttattctattcgtcctcgtgaaaatgaatataaaacaattcttacaaaccttgatgaatataacaagttgacaacaaacaacaacgaaaacaaatatttacaattgaagaaacttaatgaatctattgatgtatttatgaataaatataaaaattcttctcgtaatcgtgctttatctaatcttaagaaagatattttaaaagaagtaattttaattaaaaattctaatacatctcctgtagaaaagaaccttcattttgtagctattggaggagaagtatctgatattgctcttgaatatattaaacaatgggctgatattaacgctgaatataacattaagttgtggtatgattctgaagcattccttgtaaacacacttaagaaagctattgtagaatcttctacaacagaagctcttcaacttcttgaagaagaaattcaaaatcctcaatttgataatatgaaattttataaaaaacgtatggaatttatttatgatcgtcaaaaacgttttattaactattataaatctcaaattaacaaacctacagtacctacaattgatgatattattaaatctcatttagtatctgaatataatcgtgatgaaacattattagaatcttatcgtacaaattctttacgtaaaattaattctaatcatggaattgatattcgtgctaattctttatttacagaacaagaattattaaatatttattctcaagaacttcttaaccgtggaaaccttgctgctgcttctgatattgtacgtcttcttgctcttaaaaactttggaggagtatatcttgatgtagctatgcttcctggaattcattctgatctttttaaaacaattcctcgtccttcttctattggattagatcgttgggaaatgattaagttggaagctattatgaaatataaaaaatatattaacaactatacatctgaaaactttgataagttggatcaacaattaaaagataattttaagttgattattgaatctaaatctgaaaaatctgaaatcttctctaagttggaaaatttaaatgtatctgatttagaaattaaaattgcttttgctttaggatctgtaattaatcaagctcttatttctaaacaaggatcttatttaacaaatttagtaattgaacaagtaaaaaatcgttatcaatttttaaatcaacatttaaatcctgctattgaatctgataataattttacagatacaacaaaaatttttcatgattctttatttaattctgctacagctgaaaactctatgtttcttacaaaaattgctccttatcttcaagtaggatttatgcctgaagctcgttctacaatttctttatctggacctggagcttatgcttctgcttattatgattttattaaccttcaagaaaatacaattgaaaaaacattaaaggcttctgatcttattgaatttaaatttcctgaaaacaacctttctcaacttacagaacaacaaattaattctttatggtcttttgatcaagcatctgctaaatatcaatttgaaaaatatgtacgtgattatacaggaggatctttatctgaagataatggagtagattttaacaaaaacacagctcttgataaaaactatcttcttaacaacaaaattccttctaataatgtagaagaagctggatctaaaaattacgtacattatattattcaattacaaggtgatgatatttcttatgaagctacatgtaatttattttctaaaaatcctaaaaattctattattattcaacgtaatatgaatgaatctgctaaatcttacttcctttctgatgatggagaatctattcttgaacttaacaaatatcgtattcctgaacgtcttaaaaacaaagaaaaagtaaaagtaacatttattggacatggaaaagatgaatttaacacatctgaatttgctcgtctttctgtagattctctttctaacgaaatttcttcattccttgatacaattaagttggatatttctcctaaaaacgtagaagtaaaccttcttggatgtaacatgttttcttatgattttaacgtagaagaaacatatcctggaaagttgttattatctattatggataaaattacatctacattacctgatgtaaataaagattctattacaattggagctaaccaatatgaagtacgtattaactctgaaggacgtaaagaacttcttgctcattctggaaaatggattaacaaagaagaagctattatgtctgatttatcttctaaagaatatatctttttcgattctattgataataagttgaaagctaaatctaaaaatattcctggattagcttctatttctgaagatattaaaacattattattagatgcttctgtatctcctgatacaaaatttattttaaataatttaaagcttaatattgaatcttctattggagattatatttattatgaaaagttggaacctgtaaaaaacattattcataactctattgatgatcttattgatgaatttaaccttcttgaaaatgtatctgatgaattatatgaattgaagaaacttaataatttagatgaaaaatatttaatttcttttgaagatatttctaaaaataattctacatattctgtacgttttattaataaatctaatggagaatctgtatatgtagaaacagaaaaagaaatcttctctaaatattctgaacatattacaaaagaaatttctacaattaaaaattctattattacagatgtaaatggaaatttattagataatattcaattagatcatacatctcaagtaaatacattaaatgctgctttctttattcaatctttaattgattattcttctaataaagatgtattaaatgatttatctacatctgtaaaagtacaattatatgctcaattattttctacaggattaaatacaatttatgattctattcaattagtaaatttaatttctaatgctgtaaatgatacaattaatgtattacctacaattacagaaggaattcctattgtatctacaattcttgatggaattaaccttggagctgctattaaagaacttcttgatgaacatgatcctcttcttaagaaagaacttgaagctaaagtaggagtacttgctattaacatgtctctttctattgctgctacagtagcttctattgtaggaattggagctgaagtaacaatcttccttttacctattgctggaatttctgctggaattccttctttagtaaataatgaattaattttacatgataaagctacatctgtagtaaattattttaatcatttatctgaatctaaagaatatggacctttaaaaacagaagatgataaaattttagtacctattgatgatcttgtaatttctgaaattgattttaacaacaactctattaagttgggaacatgtaatattttagctatggaaggtggatctggacatacagtaacaggaaacattgatcatttcttttcttctccttatatttcttctcatattccttctttatctgtatattctgctattggaattaaaacagaaaaccttgatttttctaagaaaatcatgatgcttcctaacgctccttctcgtgtattttggtgggaaacaggagctgtacctggattacgttctttagaaaacaacggaacaaagttgcttgattctattcgtgatctttatcctggaaaattttattggcgtttttatgctttctttgattatgctattacaacattaaaacctgtatatgaagatacaaacacaaaaattaagttggataaagatacacgtaactttattatgcctacaattacaacagatgaaattcgtaacaagttgtcttattcttttgatggagctggaggaacatattctcttcttctttcttcttatcctatttctatgaatattaatttatctaaagatgatttatggatttttaatattgataatgaagtacgtgaaatttctattgaaaatggaacaatcaagaaaggaaatttaattgaagatgtattatctaaaattgatattaataaaaataagttgattattggaaatcaaacaattgatttttctggagatattgataataaagatcgttatatcttccttacatgtgaattagatgataaaatttctttaattattgaaattaaccttgtagctaaatcttattcattacttctttctggagataaaaattatttaatttctaatttatctaatacaattgaaaaaattaatacattaggattagattctaaaaatattgcttataattatacagatgaatctaataataaatattttggagctatttctaaaacatctcaaaaatcaattattcattataaaaaagattctaaaaatattttagaattttataatggatctacattagaatttaattctaaagattttattgctgaagatattaatgtatttatgaaagatgatattaatacaattacaggaaaatattatgtagataataatacagataaatctattgatttttctatttctttagtatctaaaaatcaagtaaaagtaaatggattatatttaaatgaatctgtatattcttcttatttagattttgtaaaaaattctgatggacatcataatacatctaattttatgaatttgttccttaataatatttctttttggaagttgtttggatttgaaaatattaattttgtaattgataaatattttacattagtaggaaaaacaaatttaggatatgtagaatttatttgtgataataataaaaatattgatatttattttggagaatggaaaacatcttcttctaaatctacaatcttctctggaaatggacgtaacgtagtagtagaacctatttataaccctgatacaggagaagatatttctacatctttagatttttcttatgaacctttatatggaattgatcgttatattaataaagtattaattgctcctgatttatatacatctttaattaacattaacacaaactattattctaacgaatattatcctgaaattattgtattaaatcctaatacatttcataaaaaagtaaatattaatttagattcttcttcttttgaatataaatggtctacagaaggatctgattttattttagtacgttatttagaagaatctaataagaaaatcttacaaaaaattcgtattaaaggaattttatctaatacacaatcttttaataaaatgtctattgattttaaagatattaaaaaattatctttaggatatattatgtctaattttaaatcttttaattctgaaaatgaattagatcgtgatcatttaggatttaaaattattgataataaaacatattattatgatgaagattctaaattagtaaaaggattaattaatattaataattctcttttctactttgatcctattgaatctaaccttgtaacaggatggcaaacaattaacggaaagaaatattattttgatattaatacaggagctgcttctactagttataaaattattaacggaaaacatttttattttaacaacaacggagtaatgcaacttggagtatttaaaggacctgatggatttgaatattttgctcctgctaacacacaaaacaacaacattgaaggacaagctattgtatatcaatctaaatttcttacacttaacggaaagaaatattattttgataacgattctaaagctgtaacaggatggcgtattattaataatgaaaaatattattttaatcctaataatgctattgctgctgtaggattacaagtaattgataataataaatattattttaacccagatacagctattatttctaaaggatggcaaacagtaaacggatctcgttattattttgatacagatacagctattgcttttaacggatataaaacaattgatggtaaacatttttattttgattctgattgtgtagtaaaaattggagtattttctggatctaacggttttgaatattttgcacctgctaacacatataataataatattgaaggtcaagcaattgtttatcaatcaaaatttttaacgttaaatggaaagaaatactactttgataacaactcaaaagcagttacaggatggcaaacaattgattctaaaaaatattattttaacacaaacacagctgaagctgcaacgggttggcaaacgattgatggaaagaaatactatttcaatacgaacacagctgaagctgctacgggttggcaaacaattgatggaaagaaatattacttcaacacaaacacatctattgcttctacaggatatacaattattaatggaaaatatttttattttaatacagatggaattatgcaaattggagtatttaaagtacctaacggatttgaatattttgcaccagctaatacacataataataacatcgagggtcaagcaattctttatcaaaacaaatttcttacacttaatggaaagaaatattatttcggatctgattctaaagctattacgggttggcagacgatcgacggaaagaaatactacttcaaccctaacaacgctattgctgctacacatttatgtacgattaacaacgataaatattatttttcttatgatggaattcttcaaaacggatatattacaattgaacgtaataatttttattttgatgctaacaacgaatctaaaatggtaacaggtgtttttaaaggaccaaatggtttcgagtattttgcaccagcaaacacacataataataacatagagggtcaagcaattgtatatcaaaataaatttttaacgttaaacggaaagaaatactacttcgataatgattcaaaagcagtgacgggatggcagacaatcgactctaaaaaatactattttaatttaaatacagctgtagctgtaacgggatggcaaacgattgatggtgagaagtattattttaatcttaatacggctgaagctgcaacgggctggcagacaattgatggaaaacgttattattttaatacgaacacatatattgcatcaacgggttatacgattattaacggtaagcacttttattttaacacggatggtattatgcaaattggtgtttttaaaggtccagatggttttgaatattttgctccagctaacacacataataacaatattgaaggtcaagctattttatatcaaaataaatttcttacgttaaatggaaagaaatattatttcgggtctgattcaaaagcagtaacaggacttcgtactatcgacggaaagaaatattacttcaatacaaacacagctgtagctgtaacaggttggcaaacgatcaacggaaagaaatactattttaatacgaatacatatattgcatcaacaggttatacgattatttctggcaagcatttctactttaacacggacggtattatgcaaattggagtttttaaaggtcctgacggtttcgaatattttgctcctgcaaacacagatgctaataatattgaaggacaagcaattcgttatcaaaaccgtttcctttatcttcatgataacatttattattttggaaacgattctaaagctgctacaggatgggctacaattgatggaaatcgttattattttgaacctaatacagctatgggagcaaatggttataaaacgattgataacaaaaacttttattttcgtaacggacttcctcaaattggtgtgtttaaaggaccaaatggcttcgaatattttgcacctgcaaatacagatgctaacaacattgatggacaagctattcgatatcaaaatcgtttccttcatcttcttggaaaaatttattattttggtaataactcaaaagcagtgacaggttggcaaacgattaactctaaagtatattattttatgcctgatacagctatggctgctgctggaggattatttgaaattgatggagtaatttactttttcggagtagatggagtaaaagctcctggaatttatggg

SEQ ID NO: 30 - DNA, 8133 bp, Artificial Sequence
  VPI strain, 4mTcdA, bacillus megaterium optimized (W101A, D287A, E514Q, W519A)
atgtcgctgattagcaaggaagagctgattaagttggcgtatagcattcgcccgcgcgagaacgaatataagacgatcctgaccaacttggatgagtataataaattgactacgaacaataacgagaacaagtatttgcagctgaagaaactgaatgagtccatcgacgtctttatgaataagtacaaaacgtcttcgcgcaaccgcgccttgtctaacctgaagaaggacattttgaaggaggtcattctgattaagaatagcaatacgagcccggttgaaaagaacctgcattttgtcgccattggcggtgaagttagcgacattgcgctggaatatatcaagcaatgggcagacattaacgcggagtataacatcaagttgtggtacgactctgaggcatttttggttaacactttgaaaaaggccatcgtggagagcagcacgactgaagcgttgcaattgctggaggaagagatccagaatccgcagtttgacaatatgaaattctacaagaaacgcatggagttcatttatgaccgtcaaaaacgcttcattaactactataaatcccaaatcaacaaaccgaccgttccaacgatcgatgacattatcaaatcccacctggtgtcggagtacaatcgcgacgaaaccgttctggagtcctaccgcaccaacagcctgcgcaaaatcaatagcaatcatggcattgatattcgtgctaactcgttgttcactgaacaggaactgttgaatatttacagccaggagttgttgaaccgtggtaacctggcggcggcgtcggacatcgttcgcttgctggcgctgaagaacttcggtggtgtttatctggatgttgccatgctgccgggcattcactctgacttgtttaaaaccattagccgtccatccagcatcggcctggatcgttgggagatgattaaactggaagccatcatgaagtataagaaatacatcaacaactacacctcggaaaacttcgataaattggatcaacaattgaaagataactttaagctgattatcgagagcaagtctgaaaagagcgaaattttcagcaaactggagaacctgaatgtgagcgacctggagattaagattgcgttcgcgctgggttcggttatcaaccaggcactgatcagcaaacaaggctcctatttgacgaacttggtgatcgagcaggtcaaaaaccgctaccaattcctgaaccaacatctgaatccggccatcgaatccgataataactttacggacaccaccaagattttccatgactctctgtttaactccgcgaccgccgaaaattctatgtttctgaccaaaatcgccccttatttgcaagtcggcttcatgccggaggctcgcagcacgatcagcttgtctggtccgggcgcttatgcgtccgcgtattacgatttcatcaacttgcaggaaaacaccatcgagaaaaccctgaaggccagcgacctgattgagtttaagtttccagagaacaatctgagccaactgaccgaacagcaaatcaattccctggctagctttgaccaagcgagcgcaaaatatcaattcgaaaagtacgtgcgtgactataccggtggtagcctgagcgaagacaacggcgttgattttaacaagaatacggcgctggataaaaactatctgctgaataataagatcccgtcgaacaacgttgaagaggctggcagcaaaaactacgtgcattacattatccaactgcaaggtgacgacatcagctatgaggccacgtgcaacctgtttagcaagaatccgaaaaactcgatcatcattcaacgcaacatgaacgagtcggcgaagagctatttcctgtctgatgacggcgagtcgattctggagctgaacaagtaccgcattccggagcgtctgaagaacaaggagaaggtcaaagttaccttcattggtcacggcaaggacgagttcaatacctccgagtttgcacgcctgtccgttgacagcttgagcaatgagattagcagctttctggacacgatcaagttggacatctctccgaaaaatgtggaggtgaacctgctgggctgcaatatgttttcctacgattttaacgttgaggaaacttatccgggtaagttgctgctgagcattatggataagattacgagcaccttgccagacgttaacaaaaactccattaccattggcgcaaatcaatatgaggtgcgtattaattcggagggtcgcaaagagctgctggcccatagcggcaaatggattaataaggaagaggctattatgtctgatctgtcttccaaggagtacatcttctttgattccattgacaataagctgaaagcgaagtcgaaaaacatcccgggtttggcatcgattagcgaggatatcaagaccttgctgttggatgcgtcggtttcgccggataccaagtttatcctgaacaatttgaagcttaacattgagagctcgatcggcgactacatttactatgagaaactggaaccggtgaagaatatcatccacaactctatcgatgacttgatcgatgaattcaacttgctggagaacgtgtccgatgagctgtatgagctgaaaaagttgaacaacctggacgagaagtatttgattagctttgaggacatttcgaaaaataactccacctatagcgtccgctttatcaacaaaagcaacggtgaatctgtgtacgtggagactgagaaggagattttcagcaagtatagcgagcatattaccaaggaaatttctaccattaaaaactccattatcacggatgtcaacggcaacctgttggataatatccagttggaccatactagccaggtgaataccctgaatgcggccttcttcatccaaagcctgattgattatagctccaacaaggacgtgttgaatgatctgagcacgtccgttaaggtgcaattgtacgcgcagttgttcagcacgggtctgaatacgatttacgatagcattcaattggttaatttgatctcgaacgcagtgaacgatacgattaacgtgctgccgaccattaccgaaggtattccgattgtcagcaccattctggacggcatcaatctgggcgcggcgatcaaggagctgctggacgagcatgatccactgctgaaaaaggaattggaggcgaaagttggcgtcctggcgattaacatgtcgctgtccattgccgcaactgtcgcctcgattgtcggcattggcgcggaggtgacgatctttctgctgccaattgcgggtatctctgcaggcattccgtccttggttaacaacgagctgattctgcacgacaaggccacctctgtggttaactactttaatcatctgagcgagtcgaagaaatatggtcctctgaagaccgaagatgataagattctggtgccgatcgacgatttggtgatcagcgagattgactttaacaacaactcgatcaagctgggtacctgtaatatcctggctatggagggtggctcgggtcacaccgtcacgggtaatatcgaccacttcttcagcagcccgagcattagctcgcacattccgtctctgtcgatttactcggccatcggtatcgaaaccgagaacctggactttagcaagaagatcatgatgctgccaaatgcaccttctcgtgtcttttggtgggaaacgggcgctgttccaggcctgcgttctctggaaaacgatggtacccgcttgctggactcgatccgcgatttgtacccgggcaaattctactggcgtttctatgcgttctttgactacgcgattaccaccctgaagccagtttacgaggataccaacatcaaaattaagctggataaagatactcgtaactttattatgccgacgatcaccacgaacgagattcgcaacaaactgtcctattctttcgacggtgcgggcggtacctatagcttgctgctgagctcttacccgatctccacgaatattaacctgagcaaggacgatttgtggatcttcaacattgataacgaggtgcgtgagatctctatcgagaatggtacgattaagaagggtaagctgatcaaagacgttctgagcaaaattgacattaacaagaataagctgattattggcaaccagaccattgatttttcgggcgacatcgataacaaggaccgctacattttcctgacttgcgaactggatgacaagatcagcttgattatcgaaattaatctggtcgccaaaagctactccttgttgctgtccggcgacaaaaactatctgatctctaacctgtcgaatacgatcgaaaagattaacactctgggtctggacagcaagaacatcgcgtataactataccgacgagtctaacaacaagtatttcggtgcaatctcgaagacgagccagaagtcgatcatccactacaaaaaggactctaagaacattctggagttctataacgactctaccttggaattcaattcgaaggattttatcgccgaagacatcaacgtgttcatgaaggatgatatcaatacgatcaccggtaagtactatgtcgataataacaccgataaatccattgacttcagcatctcgctggtttctaaaaaccaagtgaaggttaacggtctgtatctgaatgagagcgtttattcctcctatttggactttgtgaaaaacagcgacggtcatcataacacctccaactttatgaacctgtttctggacaacatttccttctggaaactgtttggcttcgagaatattaactttgtgattgacaaatactttactctggttggtaaaaccaacctgggttacgtggagtttatctgcgacaacaataagaatatcgacatctacttcggtgaatggaaaaccagcagctccaagagcaccatcttctctggtaacggccgtaacgtggtcgtggagccgatttacaatccggacactggcgaagatatttccacttctctggatttcagctatgaaccgctgtatggcattgatcgctacatcaataaagtgctgattgcgccagatctctacacgagcctgatcaatattaacacgaattactactccaacgagtattacccggagattattgtgttgaacccgaatacctttcacaagaaagtgaacattaacttggatagctccagctttgaatacaaatggtcgacggagggctccgatttcattctggtccgttacctggaggagtccaacaagaagattttgcagaaaatccgtattaaaggcatcctgagcaatacccagagcttcaacaagatgtccatcgactttaaagacattaagaagctgtcgttgggctatatcatgtcgaattttaagagctttaactccgaaaacgaactggaccgtgatcatctgggctttaagatcattgataataagacctattactacgacgaagacagcaagctggtcaaaggcctgattaatatcaacaacagcttgttctactttgatccaattgagtttaacctggtcacgggttggcaaaccattaacggtaaaaagtattactttgacatcaatacgggcgcagctctgactagttacaaaatcattaacggcaaacatttctacttcaataacgacggcgttatgcagctgggtgttttcaaaggtccggatggttttgaatactttgccccggcaaacacccaaaacaacaacatcgaaggtcaggcaatcgtttatcagtccaaatttctgaccctgaacggtaaaaagtattacttcgacaacaattccaaagccgtaaccggttggcgcattattaacaacgagaagtactatttcaacccgaacaacgcgattgccgctgtgggcctgcaggttatcgacaacaacaaatattactttaacccggataccgcgatcatttccaaaggctggcagactgttaacggtagccgttactacttcgacacggataccgctattgcattcaacggttataaaaccattgatggcaaacacttctactttgattctgactgtgttgtgaaaatcggcgttttctctacctccaacggctttgaatacttcgctccggctaatacctacaacaataacatcgaaggtcaggccatcgtgtaccagtctaaattcctgaccctgaacggtaagaaatactatttcgacaacaactctaaagccgttaccggcctgcagaccatcgacagcaaaaagtactacttcaacactaacacggcggaagcagcgactggttggcagaccatcgacggcaaaaagtactattttaacactaatactgcggaggctgcgaccggctggcaaactatcgacggtaagaaatactactttaacaccaataccgctattgcttctaccggctacactatcatcaacggtaaacacttctatttcaacaccgatggtatcatgcagatcggtgtttttaaaggtcctaacggcttcgaatacttcgctccggcgaacaccgacgctaacaacattgaaggccaggctatcctgtaccagaatgaatttctgaccctgaacggcaagaaatattactttggttctgattctaaagccgtgaccggttggcgtatcatcaacaacaagaaatattacttcaacccgaacaacgcgattgcggctatccacctgtgcacgatcaacaacgacaaatactacttctcctatgatggcatcctgcagaacggttacatcaccattgagcgcaacaacttttacttcgacgcgaacaatgaatctaaaatggtaaccggtgtttttaaaggcccgaacggttttgagtactttgccccagcgaacacccataacaacaatattgagggccaggcgattgtatatcagaacaaatttctgactctgaacggcaagaaatactacttcgacaacgacagcaaagcggttactggctggcagaccattgatggcaaaaagtactatttcaacctgaacactgcagaagctgcgacgggctggcagactattgatggtaagaaatactacttcaacctgaacactgctgaagctgcgactggctggcagacgatcgacggcaagaaatattacttcaacaccaacaccttcatcgcgagcactggttatacgagcatcaacggtaaacacttctacttcaacaccgatggcattatgcagatcggtgtattcaaaggcccgaacggcttcgaatatttcgcaccggcgaacactgatgccaacaatatcgaaggtcaggcaatcctgtaccagaacaaatttctgaccctgaacggcaagaaatactattttggttctgactctaaggcagtaaccggtctgcgtacgatcgacggcaaaaagtactacttcaacactaacaccgcagtggccgttaccggttggcagaccatcaacggcaagaaatactactttaacaccaatactagcatcgcttctaccggttacaccatcatctccggcaagcacttctacttcaacaccgatggtattatgcagatcggtgtgttcaaaggtcctgatggtttcgaatacttcgctcctgccaacacggacgctaataacatcgagggccaggccattcgttaccaaaaccgcttcctgtatctgcatgacaacatctactactttggtaacaactccaaagcggcgaccggttgggttaccattgatggcaaccgttactattttgaaccgaacactgcgatgggcgcgaatggttataaaaccattgacaacaaaaacttctacttccgtaacggcctgccgcagattggcgtgttcaaaggttctaatggcttcgaatacttcgcaccggctaatacggacgcgaacaacattgaaggtcaggctatccgctaccagaaccgtttcctgcatctgctgggcaagatctactacttcggcaacaactctaaagctgttaccggctggcagacgattaatggtaaagtctactacttcatgccggataccgcaatggcagcagctggtggtctgttcgagattgatggcgtaatctatttcttcggcgtggacggtgttaaagctccgggtatttatggctaa

SEQ ID NO: 31 - DNA, 8133 bp, Artificial Sequence
  VPI strain, 5mTcdA, bacillus megaterium optimized (W101A, D287A, E514Q, W519A, C700A)
atgtcgctgattagcaaggaagagctgattaagttggcgtatagcattcgcccgcgcgagaacgaatataagacgatcctgaccaacttggatgagtataataaattgactacgaacaataacgagaacaagtatttgcagctgaagaaactgaatgagtccatcgacgtctttatgaataagtacaaaacgtcttcgcgcaaccgcgccttgtctaacctgaagaaggacattttgaaggaggtcattctgattaagaatagcaatacgagcccggttgaaaagaacctgcattttgtcgccattggcggtgaagttagcgacattgcgctggaatatatcaagcaatgggcagacattaacgcggagtataacatcaagttgtggtacgactctgaggcatttttggttaacactttgaaaaaggccatcgtggagagcagcacgactgaagcgttgcaattgctggaggaagagatccagaatccgcagtttgacaatatgaaattctacaagaaacgcatggagttcatttatgaccgtcaaaaacgcttcattaactactataaatcccaaatcaacaaaccgaccgttccaacgatcgatgacattatcaaatcccacctggtgtcggagtacaatcgcgacgaaaccgttctggagtcctaccgcaccaacagcctgcgcaaaatcaatagcaatcatggcattgatattcgtgctaactcgttgttcactgaacaggaactgttgaatatttacagccaggagttgttgaaccgtggtaacctggcggcggcgtcggacatcgttcgcttgctggcgctgaagaacttcggtggtgtttatctggatgttgccatgctgccgggcattcactctgacttgtttaaaaccattagccgtccatccagcatcggcctggatcgttgggagatgattaaactggaagccatcatgaagtataagaaatacatcaacaactacacctcggaaaacttcgataaattggatcaacaattgaaagataactttaagctgattatcgagagcaagtctgaaaagagcgaaattttcagcaaactggagaacctgaatgtgagcgacctggagattaagattgcgttcgcgctgggttcggttatcaaccaggcactgatcagcaaacaaggctcctatttgacgaacttggtgatcgagcaggtcaaaaaccgctaccaattcctgaaccaacatctgaatccggccatcgaatccgataataactttacggacaccaccaagattttccatgactctctgtttaactccgcgaccgccgaaaattctatgtttctgaccaaaatcgccccttatttgcaagtcggcttcatgccggaggctcgcagcacgatcagcttgtctggtccgggcgcttatgcgtccgcgtattacgatttcatcaacttgcaggaaaacaccatcgagaaaaccctgaaggccagcgacctgattgagtttaagtttccagagaacaatctgagccaactgaccgaacagcaaatcaattccctggctagctttgaccaagcgagcgcaaaatatcaattcgaaaagtacgtgcgtgactataccggtggtagcctgagcgaagacaacggcgttgattttaacaagaatacggcgctggataaaaactatctgctgaataataagatcccgtcgaacaacgttgaagaggctggcagcaaaaactacgtgcattacattatccaactgcaaggtgacgacatcagctatgaggccacgtgcaacctgtttagcaagaatccgaaaaactcgatcatcattcaacgcaacatgaacgagtcggcgaagagctatttcctgtctgatgacggcgagtcgattctggagctgaacaagtaccgcattccggagcgtctgaagaacaaggagaaggtcaaagttaccttcattggtcacggcaaggacgagttcaatacctccgagtttgcacgcctgtccgttgacagcttgagcaatgagattagcagctttctggacacgatcaagttggacatctctccgaaaaatgtggaggtgaacctgctgggcgccaatatgttttcctacgattttaacgttgaggaaacttatccgggtaagttgctgctgagcattatggataagattacgagcaccttgccagacgttaacaaaaactccattaccattggcgcaaatcaatatgaggtgcgtattaattcggagggtcgcaaagagctgctggcccatagcggcaaatggattaataaggaagaggctattatgtctgatctgtcttccaaggagtacatcttctttgattccattgacaataagctgaaagcgaagtcgaaaaacatcccgggtttggcatcgattagcgaggatatcaagaccttgctgttggatgcgtcggtttcgccggataccaagtttatcctgaacaatttgaagcttaacattgagagctcgatcggcgactacatttactatgagaaactggaaccggtgaagaatatcatccacaactctatcgatgacttgatcgatgaattcaacttgctggagaacgtgtccgatgagctgtatgagctgaaaaagttgaacaacctggacgagaagtatttgattagctttgaggacatttcgaaaaataactccacctatagcgtccgctttatcaacaaaagcaacggtgaatctgtgtacgtggagactgagaaggagattttcagcaagtatagcgagcatattaccaaggaaatttctaccattaaaaactccattatcacggatgtcaacggcaacctgttggataatatccagttggaccatactagccaggtgaataccctgaatgcggccttcttcatccaaagcctgattgattatagctccaacaaggacgtgttgaatgatctgagcacgtccgttaaggtgcaattgtacgcgcagttgttcagcacgggtctgaatacgatttacgatagcattcaattggttaatttgatctcgaacgcagtgaacgatacgattaacgtgctgccgaccattaccgaaggtattccgattgtcagcaccattctggacggcatcaatctgggcgcggcgatcaaggagctgctggacgagcatgatccactgctgaaaaaggaattggaggcgaaagttggcgtcctggcgattaacatgtcgctgtccattgccgcaactgtcgcctcgattgtcggcattggcgcggaggtgacgatctttctgctgccaattgcgggtatctctgcaggcattccgtccttggttaacaacgagctgattctgcacgacaaggccacctctgtggttaactactttaatcatctgagcgagtcgaagaaatatggtcctctgaagaccgaagatgataagattctggtgccgatcgacgatttggtgatcagcgagattgactttaacaacaactcgatcaagctgggtacctgtaatatcctggctatggagggtggctcgggtcacaccgtcacgggtaatatcgaccacttcttcagcagcccgagcattagctcgcacattccgtctctgtcgatttactcggccatcggtatcgaaaccgagaacctggactttagcaagaagatcatgatgctgccaaatgcaccttctcgtgtcttttggtgggaaacgggcgctgttccaggcctgcgttctctggaaaacgatggtacccgcttgctggactcgatccgcgatttgtacccgggcaaattctactggcgtttctatgcgttctttgactacgcgattaccaccctgaagccagtttacgaggataccaacatcaaaattaagctggataaagatactcgtaactttattatgccgacgatcaccacgaacgagattcgcaacaaactgtcctattctttcgacggtgcgggcggtacctatagcttgctgctgagctcttacccgatctccacgaatattaacctgagcaaggacgatttgtggatcttcaacattgataacgaggtgcgtgagatctctatcgagaatggtacgattaagaagggtaagctgatcaaagacgttctgagcaaaattgacattaacaagaataagctgattattggcaaccagaccattgatttttcgggcgacatcgataacaaggaccgctacattttcctgacttgcgaactggatgacaagatcagcttgattatcgaaattaatctggtcgccaaaagctactccttgttgctgtccggcgacaaaaactatctgatctctaacctgtcgaatacgatcgaaaagattaacactctgggtctggacagcaagaacatcgcgtataactataccgacgagtctaacaacaagtatttcggtgcaatctcgaagacgagccagaagtcgatcatccactacaaaaaggactctaagaacattctggagttctataacgactctaccttggaattcaattcgaaggattttatcgccgaagacatcaacgtgttcatgaaggatgatatcaatacgatcaccggtaagtactatgtcgataataacaccgataaatccattgacttcagcatctcgctggtttctaaaaaccaagtgaaggttaacggtctgtatctgaatgagagcgtttattcctcctatttggactttgtgaaaaacagcgacggtcatcataacacctccaactttatgaacctgtttctggacaacatttccttctggaaactgtttggcttcgagaatattaactttgtgattgacaaatactttactctggttggtaaaaccaacctgggttacgtggagtttatctgcgacaacaataagaatatcgacatctacttcggtgaatggaaaaccagcagctccaagagcaccatcttctctggtaacggccgtaacgtggtcgtggagccgatttacaatccggacactggcgaagatatttccacttctctggatttcagctatgaaccgctgtatggcattgatcgctacatcaataaagtgctgattgcgccagatctctacacgagcctgatcaatattaacacgaattactactccaacgagtattacccggagattattgtgttgaacccgaatacctttcacaagaaagtgaacattaacttggatagctccagctttgaatacaaatggtcgacggagggctccgatttcattctggtccgttacctggaggagtccaacaagaagattttgcagaaaatccgtattaaaggcatcctgagcaatacccagagcttcaacaagatgtccatcgactttaaagacattaagaagctgtcgttgggctatatcatgtcgaattttaagagctttaactccgaaaacgaactggaccgtgatcatctgggctttaagatcattgataataagacctattactacgacgaagacagcaagctggtcaaaggcctgattaatatcaacaacagcttgttctactttgatccaattgagtttaacctggtcacgggttggcaaaccattaacggtaaaaagtattactttgacatcaatacgggcgcagctctgactagttacaaaatcattaacggcaaacatttctacttcaataacgacggcgttatgcagctgggtgttttcaaaggtccggatggttttgaatactttgccccggcaaacacccaaaacaacaacatcgaaggtcaggcaatcgtttatcagtccaaatttctgaccctgaacggtaaaaagtattacttcgacaacaattccaaagccgtaaccggttggcgcattattaacaacgagaagtactatttcaacccgaacaacgcgattgccgctgtgggcctgcaggttatcgacaacaacaaatattactttaacccggataccgcgatcatttccaaaggctggcagactgttaacggtagccgttactacttcgacacggataccgctattgcattcaacggttataaaaccattgatggcaaacacttctactttgattctgactgtgttgtgaaaatcggcgttttctctacctccaacggctttgaatacttcgctccggctaatacctacaacaataacatcgaaggtcaggccatcgtgtaccagtctaaattcctgaccctgaacggtaagaaatactatttcgacaacaactctaaagccgttaccggcctgcagaccatcgacagcaaaaagtactacttcaacactaacacggcggaagcagcgactggttggcagaccatcgacggcaaaaagtactattttaacactaatactgcggaggctgcgaccggctggcaaactatcgacggtaagaaatactactttaacaccaataccgctattgcttctaccggctacactatcatcaacggtaaacacttctatttcaacaccgatggtatcatgcagatcggtgtttttaaaggtcctaacggcttcgaatacttcgctccggcgaacaccgacgctaacaacattgaaggccaggctatcctgtaccagaatgaatttctgaccctgaacggcaagaaatattactttggttctgattctaaagccgtgaccggttggcgtatcatcaacaacaagaaatattacttcaacccgaacaacgcgattgcggctatccacctgtgcacgatcaacaacgacaaatactacttctcctatgatggcatcctgcagaacggttacatcaccattgagcgcaacaacttttacttcgacgcgaacaatgaatctaaaatggtaaccggtgtttttaaaggcccgaacggttttgagtactttgccccagcgaacacccataacaacaatattgagggccaggcgattgtatatcagaacaaatttctgactctgaacggcaagaaatactacttcgacaacgacagcaaagcggttactggctggcagaccattgatggcaaaaagtactatttcaacctgaacactgcagaagctgcgacgggctggcagactattgatggtaagaaatactacttcaacctgaacactgctgaagctgcgactggctggcagacgatcgacggcaagaaatattacttcaacaccaacaccttcatcgcgagcactggttatacgagcatcaacggtaaacacttctacttcaacaccgatggcattatgcagatcggtgtattcaaaggcccgaacggcttcgaatatttcgcaccggcgaacactgatgccaacaatatcgaaggtcaggcaatcctgtaccagaacaaatttctgaccctgaacggcaagaaatactattttggttctgactctaaggcagtaaccggtctgcgtacgatcgacggcaaaaagtactacttcaacactaacaccgcagtggccgttaccggttggcagaccatcaacggcaagaaatactactttaacaccaatactagcatcgcttctaccggttacaccatcatctccggcaagcacttctacttcaacaccgatggtattatgcagatcggtgtgttcaaaggtcctgatggtttcgaatacttcgctcctgccaacacggacgctaataacatcgagggccaggccattcgttaccaaaaccgcttcctgtatctgcatgacaacatctactactttggtaacaactccaaagcggcgaccggttgggttaccattgatggcaaccgttactattttgaaccgaacactgcgatgggcgcgaatggttataaaaccattgacaacaaaaacttctacttccgtaacggcctgccgcagattggcgtgttcaaaggttctaatggcttcgaatacttcgcaccggctaatacggacgcgaacaacattgaaggtcaggctatccgctaccagaaccgtttcctgcatctgctgggcaagatctactacttcggcaacaactctaaagctgttaccggctggcagacgattaatggtaaagtctactacttcatgccggataccgcaatggcagcagctggtggtctgttcgagattgatggcgtaatctatttcttcggcgtggacggtgttaaagctccgggtatttatggctaa

SEQ ID NO: 32 - DNA, 7098 bp, Artificial Sequence
  NAP strain, 3mTcdB, bacillus megaterium optimized (W102A, D288A, E515Q)
atgtctttagtaaaccgtaaacaattagaaaaaatggctaacgtacgttttcgtgttcaagaagatgaatatgtagctattttagatgctttagaagaatatcataatatgtctgaaaatacagtagtagaaaaatatttaaagttgaaagatattaattctttaacagatatttatattgatacatataaaaaatctggacgtaataaggctcttaagaaatttaaagaatatcttgtaacagaagtattagaacttaaaaacaacaaccttacacctgtagaaaagaacttacattttgtagctattggaggacaaattaatgatacagctattaactatattaaccaatggaaagatgtaaactctgattataacgtaaacgtattttatgattctaatgctttccttattaatacacttaagaaaacaattgtagaatctgctacaaatgatacattagaatcttttcgtgaaaatttaaatgatcctcgttttgattataataaattttatcgtaaacgtatggaaattatttatgataaacaaaagaactttattaattattataaaacacaacgtgaagaaaatcctgatcttattattgatgatattgtaaaaatttatctttctaacgaatattctaaagatattgatgaattaaattcttatattgaagaatctttaaataaagtaacagaaaactctggaaacgatgtacgtaactttgaagaatttaaaggaggagaatcttttaagttgtatgaacaagaattagtagaacgttggaacttagctgctgcttctgatattcttcgtatttctgctcttaaagaagtaggaggagtatatcttgatgtagctatgcttcctggaattcaacctgatctttttgaatctattgaaaaaccttcttctgtaacagtagatttttgggaaatggtaaaattagaagctattatgaaatataaagaatatattcctggatatacatctgaacattttgatatgcttgatgaagaagtacaatcttcttttgaatctgtacttgcttctaaatctgataaatctgaaatcttctcttcacttggagatatggaagcatctcctttagaagtaaaaattgcttttaattctaaaggaattattaatcaaggattaatttctgtaaaagattcttattgttctaaccttattgtaaaacaaattgaaaaccgttataaaattcttaacaactctcttaatcctgctatttctgaagataatgattttaatacaacaacaaatgcttttattgattctattatggctgaagctaacgctgataacggacgttttatgatggaacttggaaaatatcttcgtgtaggatttttccctgatgtaaaaacaacaattaacctttctggacctgaagcatacgctgctgcttatcaagatttattaatgtttaaagaaggatctatgaacattcatcttattgaagctgatcttcgtaactttgaaatttctaaaacaaacatttctcaatctacagaacaacaaatggcttctttatggtcttttgatgatgctcgtgctaaagctcaatttgaagaatataagaaaaactattttgaaggatctttaggagaagatgataaccttgatttttctcaaaacacagtagtagataaagaatatcttttagaaaaaatttcttctttagctcgttcttctgaacgtggatatattcattatattgttcaattacaaggagataaaatttcttatgaagctgcttgtaatttatttgctaaaacaccttatgattctgtactttttcaaaagaacattgaagattctgaaattgcttattattataatcctggagatggagaaattcaagaaattgataaatataaaattccttctattatttctgatcgtcctaaaattaagttgacatttattggacatggaaaagatgaatttaacacagatatttttgctggacttgatgtagattctctttctacagaaattgaaacagctattgatttagctaaagaagatatttctcctaaatctattgaaattaaccttcttggatgtaacatgttttcttattctgtaaatgtagaagaaacatatcctggaaagttgcttcttcgtgtaaaagataaagtatctgaacttatgccttctatttctcaagattctattattgtatctgctaatcaatatgaagtacgtattaattctgaaggacgtcgtgaattattagatcattctggagaatggattaataaagaagaatctattattaaagatatttcttctaaagaatatatttcttttaaccctaaagaaaacaaaattattgtaaaatctaaaaacttacctgaattatctacattattacaagaaattcgtaataattctaattcttctgatattgaattagaagaaaaagtaatgttagctgaatgtgaaattaatgtaatttctaatattgatacacaagtagtagaaggacgtattgaagaagctaaaagcttaacatctgattctattaactatattaaaaacgaatttaagttgattgaatctatttctgatgctctttatgatttaaaacaacaaaatgaattagaagaatctcattttatttcttttgaagatattttagaaacagatgaaggattttctattcgttttattgataaagaaacaggagaatctatttttgtagaaacagaaaaagctatcttctctgaatatgctaatcatattacagaagaaatttctaaaattaaaggaacaatttttgatacagtaaatggaaagttggtaaagaaagtaaatttagatgctacacatgaagtaaatacattaaatgctgctttctttattcaatctttaattgaatataactcttctaaagaatctttatctaacctttctgtagctatgaaagtacaagtatatgctcaattattttctacaggacttaacacaattacagatgctgctaaagtagtagaacttgtatctacagctcttgatgaaacaattgatcttcttcctacactttctgaaggacttcctgtaattgctacaattattgatggagtatctttaggagctgctattaaagaactttctgaaacatctgatcctcttcttcgtcaagaaattgaagctaaaattggaattatggctgtaaacttaacagctgctacaacagctattattacgtcttctttaggaattgcttctggattttctattcttcttgtacctcttgctggaatttctgctggaattccttctttagtaaacaacgaacttattcttcgtgataaagctacaaaagtagtagattatttttctcatatttctttagctgaatctgaaggtgcttttacatctttagatgataaaattatgatgcctcaagatgatcttgtaatttctgaaattgattttaacaacaactctattacacttggaaaatgtgaaatttggcgtatggaaggtggatctggacatacagtaacagatgatattgatcatttcttttctgctccttctattacatatcgtgaacctcatctttctatttatgatgtacttgaagtacaaaaagaagaacttgatctttctaaagatttaatggtattacctaatgctcctaatcgtgtatttgcttgggaaacaggatggacacctggattacgttctttagaaaacgatggaacaaagttgcttgatcgtattcgtgataactatgagggagaattttattggcgatattttgcttttattgctgatgctcttattacaacacttaaacctcgttatgaagatacaaacattcgtattaaccttgattctaatacacgttcttttattgtacctgtaattacaacagaatatattcgtgaaaagttgtcttattctttttatggatctggaggaacatatgctttatctttatctcaatataacatgaacattaacattgaacttaacgaaaatgatacatgggtaattgatgtagataacgtagtacgtgatgtaacaattgaatctgataaaatcaaaaagggagatttaattgaaaatattctttctaagttgtctattgaagataataaaattattttagataatcatgaaattaatttttctggaacattaaatggaggaaatggatttgtatctttaacgttttctattttagaaggaattaatgctgtaattgaagtagatttattatctaaatcttataaagtattaatttctggagaattaaaaacattaatggctaattctaattctgttcaacaaaaaattgattatattggattaaattctgaattacaaaagaacattccttattcttttatggatgataaaggaaaagaaaatggatttattaattgttctacaaaagaaggattatttgtatctgaattatctgatgtagtattaatttctaaagtatatatggataattctaaacctttatttggatattgttctaatgatttaaaagatgtaaaagttattacaaaagatgatgtaattattttaacaggatattatcttaaagatgatattaaaatttctttatcttttacaattcaagatgaaaatacaattaagttgaatggagtatatcttgatgaaaatggagtagctgaaattttaaaatttatgaataaaaaaggatctacaaatacatctgattctttaatgtctttccttgaatctatgaatattaaatcaatttttattaattctttacaatctaatacaaagttgattttagatacgaactttattatttctggaacaacatctattggacaatttgaatttatttgtgataaagataacaacattcaaccttattttattaaatttaacacattagaaacaaaatatacattatatgtaggaaatcgtcaaaatatgattgtagaacctaattatgatttagatgattctggagatatttcttctacagtaattaatttttctcaaaaatatttatatggaattgattcttgtgtaaataaagtaattatttctcctaatatttatacagatgaaattaatattacacctatttatgaagctaataatacatatcctgaagtaattgtacttgatacaaactatatttctgaaaaaattaacattaacattaacgatctttctattcgttatgtatggtctaatgatggatctgattttattttaatgtctacagatgaagaaaataaagtatctcaagtaaaaattcgttttacaaatgtatttaaaggaaatacaatttctgataaaatttcttttaatttttctgataaacaagatgtatctattaataaagtaatttctacatttacaccttcttattatgtagaaggacttcttaactatgatcttggtcttatttctttatataatgaaaaattttatattaacaattttggaatgatggtatctggattagtatatattaatgattctttatattattttaaacctcctattaaaaatttaattacaggatttacaacaattggagatgataaatattattttaatcctgataacggaggagctgcttctgtaggagaaacaattattgatggaaaaaactattatttttctcaaaacggagtacttcaaacaggagtattttctacagaagatggatttaaatattttgctcctgctgatacacttgatgaaaatctagagggagaagctattgattttacgggaaagttgacaattgatgaaaacgtatattattttggagataactatcgtgctgctattgaatggcaaacacttgatgatgaagtatattatttttctacagatacaggacgtgcttttaaaggattaaatcaaattggagatgataaattttattttaattctgatggaattatgcaaaaaggatttgtaaacattaacgataaaacattttattttgatgattctggagtaatgaaatctggatatacagaaattgatggaaaatatttttattttgcagaaaatggagaaatgcaaattggagtatttaacacagctgatggttttaaatattttgctcatcatgatgaagatcttggaaatgaagagggagaagctctttcatattctggaattcttaactttaataacaaaatttattattttgatgattcttttacagctgtagtaggatggaaagatcttgaagatggatctaaatattattttgatgaagatacagctgaagcatacattggaatttctattattaacgatggaaaatattattttaacgattctggaattatgcaaattggatttgtaacaattaataatgaagtattttatttttctgattctggaattgtagaatctggaatgcaaaatattgatgataattatttttatattgatgaaaatggattagtacaaattggagtatttgatacatctgatggatataaatattttgcaccagctaacacagtaaacgataacatttatggacaagctgtagaatattctggacttgtacgtgtaggagaagatgtatattattttggagaaacatatacaattgaaacaggatggatttatgatatggaaaatgaatctgataaatattattttgatcctgaaacaaaaaaggcttacaaaggaattaacgtaattgatgatatcaagtattattttgatgaaaacggaattatgcgtacaggattaattacatttgaagataatcattattattttaatgaagatggaattatgcaatatggatatttaaatattgaagataaaacgttttatttttcagaagatggtattatgcaaattggtgtttttaatacacctgacggttttaaatattttgcacatcaaaacacacttgatgaaaactttgagggagaatctattaactatacaggatggcttgatcttgatgaaaaacgttattattttacagatgaatatattgctgctacaggatctgtaattattgatggagaagaatattattttgatccagatacagctcaattagtaatttctgag

SEQ ID NO: 33 - DNA, 7101 bp, Artificial Sequence
  VPI strain, 4mTcdB, bacillus megaterium optimized (W102A, D288A, E515Q, W520A)
atgtctcttgtaaaccgtaaacaacttgaaaaaatggctaacgttcgttttagaacacaagaagatgaatatgtagctattcttgatgcacttgaagaatatcataatatgtcagaaaacacggtagttgaaaaatatcttaaacttaaagatattaacagcttaacagatatttatattgatacgtataaaaaatctggaagaaataaagcacttaaaaaatttaaagaatatttagtaacagaagttcttgaacttaaaaacaacaaccttacgcctgtagaaaagaatcttcattttgttgctattggaggtcaaattaacgatacagcaattaactatattaaccaatggaaagatgttaattcagattataacgtaaatgtattttatgatagtaacgcatttttaattaatacattaaagaaaacagtagttgaatcagcaattaacgatacacttgaaagttttcgtgaaaaccttaacgatcctagatttgattataataaatttttccgtaaaagaatggaaattatttatgataaacagaaaaattttattaactattataaagctcaacgtgaagaaaatccagaacttattattgatgatattgtaaaaacatatttatctaatgaatattcaaaagaaattgatgaattaaacacatatattgaagagagcttaaataaaattacgcaaaactctggaaacgatgttagaaactttgaagaatttaaaaacggtgaatcttttaacctttatgaacaagaattagtagaacgttggaatttagctgcagctagtgatattcttagaattagcgctcttaaagaaattggaggaatgtatcttgatgttgcaatgttacctggaattcaaccagatctttttgaatctattgaaaaaccttcttcagtaacagttgatttttgggaaatgacgaaacttgaagctattatgaaatataaagaatatattccagaatatacatcagaacattttgatatgcttgatgaagaagtacaaagtagctttgaaagcgttcttgcatctaaatcagataaatctgaaatttttagttcacttggagatatggaagctagccctttagaagtaaaaattgcatttaattctaaaggtattattaaccaaggattaatttcagttaaagatagttattgtagcaacttaattgtaaaacaaattgaaaaccgttataaaattttaaacaactctcttaacccagctatttcagaagataacgattttaacacaacgacaaacacatttattgattctattatggctgaagcaaatgctgataacggacgttttatgatggaacttggaaaatatcttagagtaggatttttccctgatgttaaaacgacaattaacctttcaggaccagaagcatatgcagctgcatatcaagatcttcttatgtttaaagaaggttcaatgaatattcatttaattgaagctgatcttcgtaactttgaaattagtaaaacaaacattagtcaaagcacggaacaacaaatggcatctttagcttcatttgatgatgcacgtgctaaagcacaatttgaagaatataaaagaaactattttgaaggaagtcttggtgaagatgataaccttgattttagccaaaacattgtagttgataaagaatatcttcttgaaaaaattagtagcttagctcgttcttcagaaagaggatatattcattatattgttcaattacaaggtgataaaatttcttatgaagctgcatgtaacctttttgctaaaacaccttatgattctgtactttttcagaaaaatattgaagattcagaaattgcatattattataacccaggagatggtgaaattcaagaaattgataaatataaaattcctagtattattagcgatcgtccaaaaattaaacttacatttattggacatggtaaagatgaatttaacacggatatttttgctggatttgatgtagattctctttcaacagaaattgaagctgcaattgatttagcaaaagaagatatttctcctaaatcaattgaaattaaccttcttggatgtaacatgtttagttatagcattaatgttgaagaaacatatcctggtaaacttcttcttaaagtaaaagataaaatttctgaacttatgccatctatttcacaagatagtattattgtaagcgcaaaccaatatgaagttcgtattaactcagaaggacgtagagaacttcttgatcattctggtgaatggattaacaaagaagaaagtattattaaagatattagtagcaaagaatatatttcttttaatcctaaagaaaacaaaattacagttaaatcaaaaaatttaccagaattaagtacgttattacaagaaattcgtaacaatagtaattcttcagatattgaattagaagaaaaagtaatgttaacagaatgtgaaattaatgttatttcaaacattgatacgcaaattgtagaagaaagaattgaagaagctaaaaaccttacaagtgatagcattaactatattaaagatgaatttaaacttattgaatctatttcagatgcattatgtgatttaaaacaacaaaatgaattagaagattctcattttatttcatttgaagatattagcgaaacagatgaaggattttctattcgttttattaacaaagaaacgggtgaaagtatttttgtagaaacggaaaaaacaatttttagcgaatatgctaaccatattacagaagaaatttctaaaattaaaggaacaatttttgatacggttaacggtaaacttgttaaaaaagttaaccttgatacgacacatgaagtaaacacacttaacgctgctttctttattcaatcacttattgaatataacagtagcaaagaaagtcttagcaacctttcagttgctatgaaagtacaagtttatgcacaattatttagtacaggacttaacacgattacagatgctgcaaaagtagttgaattagtaagcacagctcttgatgaaacgattgatcttcttcctacactttctgaaggattaccaattattgcaacgattattgatggagtttcacttggtgctgcaattaaagaattaagtgaaacaagcgatcctcttcttcgtcaagaaattgaagctaaaattggaattatggcagttaaccttacgacagctacgacagcaattattacatcttcacttggaattgcttctggtttttcaattcttcttgtacctttagctggaatttctgcaggtattccaagcttggtaaacaacgaacttgttcttagagataaagcaacgaaagtagttgattattttaaacatgtatctcttgttgaaacagaaggagtatttacgcttcttgatgataaaattatgatgccacaagatgatcttgttatttcagaaattgattttaacaataacagtattgtattaggaaaatgtgaaatttggcgtatggaaggaggttcaggtcatacggttacagatgatattgatcatttcttttctgctcctagcattacatatagagaaccacatttatctatttatgatgtattagaagttcaaaaagaagaacttgatctttcaaaagatttaatggtattacctaatgctccaaaccgtgtttttgcatgggaaacgggatggacacctggtttaagatctttagaaaatgatggaacaaaacttcttgatcgtattagagataactatgagggtgaattttattggcgttattttgcttttattgctgatgcacttattacgacacttaaacctcgttatgaagatacaaacattagaattaacttagatagtaatacgcgtagctttattgtaccaattattacgacagaatatattagagaaaaactttcttattcattttatggatctggaggtacatatgcacttagtcttagccaatataacatgggtattaacattgaactttctgaatcagatgtatggattattgatgttgataacgtagttagagatgttacaattgaatcagataaaattaagaaaggagatttaattgaaggaattttatctacgctttcaattgaagaaaacaaaattattcttaatagtcatgaaattaactttagcggagaagtaaacggatctaacggttttgtttctcttacattttcaattttagaaggtattaatgcaattattgaagtagatcttcttagtaaaagctataaacttcttattagtggagaattaaaaattttaatgttaaacagcaatcatattcaacaaaaaattgattatattggatttaattctgaattacagaaaaatattccatatagttttgttgatagcgaaggaaaagaaaacggttttattaacggaagcacaaaagaaggactttttgtttctgaacttcctgatgtagttcttattagtaaagtatatatggatgatagtaaacctagctttggatattattctaataacttaaaagatgtaaaagttattacaaaagataacgtaaatattttaacgggatattatcttaaagatgatattaaaatttctttatcattaacattacaagatgaaaaaacgattaaattaaattcagtacatttagatgaaagtggagttgctgaaattcttaaatttatgaaccgtaagggtaacacgaatacaagtgatagcttaatgtcatttttagaatcaatgaacattaaatcaatttttgttaactttttacaaagtaacattaaatttattttagatgcaaactttattattagtggtacgacaagcattggacaatttgaatttatttgtgatgaaaacgataacattcaaccttattttattaaatttaatacgttagaaacaaactatacgctttatgtaggaaacagacaaaacatgattgttgaaccaaactatgatcttgatgattcaggagatattagtagcacagttattaactttagtcaaaaatatctttatggtattgatagctgtgtaaacaaagtagttatttctcctaacatttatacagatgaaattaacattacgcctgtatatgaaacaaacaacacgtatccagaagtaattgttttagatgctaactatattaacgaaaaaattaacgttaatattaacgatttaagcattcgttatgtatggtctaatgatggaaacgattttattcttatgtctactagtgaagaaaacaaagtatctcaagttaaaattagatttgtaaacgtttttaaagataaaacgttagcaaataaattatcttttaacttttcagataaacaagatgtacctgtttctgaaattattcttagttttacaccaagctattatgaagatggacttattggttatgatttaggattagtttcactttataacgaaaaattttatattaacaactttggtatgatggtatcaggacttatttatattaacgatagtctttattattttaaacctccagttaacaaccttattacaggttttgtaacggttggagatgataaatattattttaaccctattaacggaggtgctgcatcaattggtgaaacaattattgatgataaaaactattattttaatcaaagcggtgtattacaaacaggagtattttctacggaagatggatttaaatattttgctccagcaaacacacttgatgaaaaccttgaaggagaagctattgattttacgggtaaacttattattgatgaaaatatttattattttgatgataattatcgtggagctgtagaatggaaagaacttgatggtgaaatgcattatttttctcctgaaacgggtaaagcatttaaaggacttaaccaaattggtgattataaatattattttaactctgatggagtaatgcaaaaaggttttgtttcaattaacgataacaaacattattttgatgattcaggagtaatgaaagttggttatacagaaattgatggaaaacatttttattttgctgaaaacggagaaatgcaaattggtgtttttaacacagaagatggttttaaatattttgcacatcataacgaagatcttggtaacgaagaaggagaagaaattagttatagcggaattcttaactttaacaacaaaatctactattttgatgatagttttacagcagtagttggatggaaagatcttgaagatggtagcaaatattattttgatgaagatacggctgaagcatatattggattatctcttattaacgatggtcaatattattttaacgatgatggaattatgcaagtaggttttgttacaattaacgataaagtattttatttttctgattcaggaattattgaatcaggagtacaaaacattgatgataactatttttatattgatgataacggaatagtacaaattggtgtttttgatacatctgatggatataaatattttgctcctgcaaacacggttaacgataacatttatggtcaagctgtagaatattcaggattagtacgtgttggtgaagatgtatattattttggagaaacgtatacaattgaaacaggttggatttatgatatggaaaacgaatcagataaatattattttaatccagaaacgaaaaaagcatgtaaaggaattaaccttattgatgatattaagtactattttgatgaaaaaggaattatgagaacaggtcttatttcatttgaaaacaacaactattattttaacgaaaatggagaaatgcaatttggttatattaacattgaagataaaatgttttattttggagaagatggtgtaatgcaaattggagtttttaacacacctgacggttttaaatattttgctcatcaaaacacgcttgatgaaaactttgaaggagaatctattaactatacaggttggcttgatcttgatgaaaaacgttattattttacagatgaatatattgctgcaacgggatctgttattattgatggtgaagaatattattttgatccagatacagcacaattagtaatttcagaataa

SEQ ID NO: 34 - DNA, 7098 bp, Artificial Sequence
  NAP strain, 5mTcdB, bacillus megaterium optimized (W102A, D288A, E515Q, W520A)
atgtctttagtaaaccgtaaacaattagaaaaaatggctaacgtacgttttcgtgttcaagaagatgaatatgtagctattttagatgctttagaagaatatcataatatgtctgaaaatacagtagtagaaaaatatttaaagttgaaagatattaattctttaacagatatttatattgatacatataaaaaatctggacgtaataaggctcttaagaaatttaaagaatatcttgtaacagaagtattagaacttaaaaacaacaaccttacacctgtagaaaagaacttacattttgtagctattggaggacaaattaatgatacagctattaactatattaaccaatggaaagatgtaaactctgattataacgtaaacgtattttatgattctaatgctttccttattaatacacttaagaaaacaattgtagaatctgctacaaatgatacattagaatcttttcgtgaaaatttaaatgatcctcgttttgattataataaattttatcgtaaacgtatggaaattatttatgataaacaaaagaactttattaattattataaaacacaacgtgaagaaaatcctgatcttattattgatgatattgtaaaaatttatctttctaacgaatattctaaagatattgatgaattaaattcttatattgaagaatctttaaataaagtaacagaaaactctggaaacgatgtacgtaactttgaagaatttaaaggaggagaatcttttaagttgtatgaacaagaattagtagaacgttggaacttagctgctgcttctgatattcttcgtatttctgctcttaaagaagtaggaggagtatatcttgatgtagctatgcttcctggaattcaacctgatctttttgaatctattgaaaaaccttcttctgtaacagtagatttttgggaaatggtaaaattagaagctattatgaaatataaagaatatattcctggatatacatctgaacattttgatatgcttgatgaagaagtacaatcttcttttgaatctgtacttgcttctaaatctgataaatctgaaatcttctcttcacttggagatatggaagcatctcctttagaagtaaaaattgcttttaattctaaaggaattattaatcaaggattaatttctgtaaaagattcttattgttctaaccttattgtaaaacaaattgaaaaccgttataaaattcttaacaactctcttaatcctgctatttctgaagataatgattttaatacaacaacaaatgcttttattgattctattatggctgaagctaacgctgataacggacgttttatgatggaacttggaaaatatcttcgtgtaggatttttccctgatgtaaaaacaacaattaacctttctggacctgaagcatacgctgctgcttatcaagatttattaatgtttaaagaaggatctatgaacattcatcttattgaagctgatcttcgtaactttgaaatttctaaaacaaacatttctcaatctacagaacaacaaatggcttctttagcgtcttttgatgatgctcgtgctaaagctcaatttgaagaatataagaaaaactattttgaaggatctttaggagaagatgataaccttgatttttctcaaaacacagtagtagataaagaatatcttttagaaaaaatttcttctttagctcgttcttctgaacgtggatatattcattatattgttcaattacaaggagataaaatttcttatgaagctgcttgtaatttatttgctaaaacaccttatgattctgtactttttcaaaagaacattgaagattctgaaattgcttattattataatcctggagatggagaaattcaagaaattgataaatataaaattccttctattatttctgatcgtcctaaaattaagttgacatttattggacatggaaaagatgaatttaacacagatatttttgctggacttgatgtagattctctttctacagaaattgaaacagctattgatttagctaaagaagatatttctcctaaatctattgaaattaaccttcttggagctaacatgttttcttattctgtaaatgtagaagaaacatatcctggaaagttgcttcttcgtgtaaaagataaagtatctgaacttatgccttctatttctcaagattctattattgtatctgctaatcaatatgaagtacgtattaattctgaaggacgtcgtgaattattagatcattctggagaatggattaataaagaagaatctattattaaagatatttcttctaaagaatatatttcttttaaccctaaagaaaacaaaattattgtaaaatctaaaaacttacctgaattatctacattattacaagaaattcgtaataattctaattcttctgatattgaattagaagaaaaagtaatgttagctgaatgtgaaattaatgtaatttctaatattgatacacaagtagtagaaggacgtattgaagaagctaaaagcttaacatctgattctattaactatattaaaaacgaatttaagttgattgaatctatttctgatgctctttatgatttaaaacaacaaaatgaattagaagaatctcattttatttcttttgaagatattttagaaacagatgaaggattttctattcgttttattgataaagaaacaggagaatctatttttgtagaaacagaaaaagctatcttctctgaatatgctaatcatattacagaagaaatttctaaaattaaaggaacaatttttgatacagtaaatggaaagttggtaaagaaagtaaatttagatgctacacatgaagtaaatacattaaatgctgctttctttattcaatctttaattgaatataactcttctaaagaatctttatctaacctttctgtagctatgaaagtacaagtatatgctcaattattttctacaggacttaacacaattacagatgctgctaaagtagtagaacttgtatctacagctcttgatgaaacaattgatcttcttcctacactttctgaaggacttcctgtaattgctacaattattgatggagtatctttaggagctgctattaaagaactttctgaaacatctgatcctcttcttcgtcaagaaattgaagctaaaattggaattatggctgtaaacttaacagctgctacaacagctattattacgtcttctttaggaattgcttctggattttctattcttcttgtacctcttgctggaatttctgctggaattccttctttagtaaacaacgaacttattcttcgtgataaagctacaaaagtagtagattatttttctcatatttctttagctgaatctgaaggtgcttttacatctttagatgataaaattatgatgcctcaagatgatcttgtaatttctgaaattgattttaacaacaactctattacacttggaaaatgtgaaatttggcgtatggaaggtggatctggacatacagtaacagatgatattgatcatttcttttctgctccttctattacatatcgtgaacctcatctttctatttatgatgtacttgaagtacaaaaagaagaacttgatctttctaaagatttaatggtattacctaatgctcctaatcgtgtatttgcttgggaaacaggatggacacctggattacgttctttagaaaacgatggaacaaagttgcttgatcgtattcgtgataactatgagggagaattttattggcgatattttgcttttattgctgatgctcttattacaacacttaaacctcgttatgaagatacaaacattcgtattaaccttgattctaatacacgttcttttattgtacctgtaattacaacagaatatattcgtgaaaagttgtcttattctttttatggatctggaggaacatatgctttatctttatctcaatataacatgaacattaacattgaacttaacgaaaatgatacatgggtaattgatgtagataacgtagtacgtgatgtaacaattgaatctgataaaatcaaaaagggagatttaattgaaaatattctttctaagttgtctattgaagataataaaattattttagataatcatgaaattaatttttctggaacattaaatggaggaaatggatttgtatctttaacgttttctattttagaaggaattaatgctgtaattgaagtagatttattatctaaatcttataaagtattaatttctggagaattaaaaacattaatggctaattctaattctgttcaacaaaaaattgattatattggattaaattctgaattacaaaagaacattccttattcttttatggatgataaaggaaaagaaaatggatttattaattgttctacaaaagaaggattatttgtatctgaattatctgatgtagtattaatttctaaagtatatatggataattctaaacctttatttggatattgttctaatgatttaaaagatgtaaaagttattacaaaagatgatgtaattattttaacaggatattatcttaaagatgatattaaaatttctttatcttttacaattcaagatgaaaatacaattaagttgaatggagtatatcttgatgaaaatggagtagctgaaattttaaaatttatgaataaaaaaggatctacaaatacatctgattctttaatgtctttccttgaatctatgaatattaaatcaatttttattaattctttacaatctaatacaaagttgattttagatacgaactttattatttctggaacaacatctattggacaatttgaatttatttgtgataaagataacaacattcaaccttattttattaaatttaacacattagaaacaaaatatacattatatgtaggaaatcgtcaaaatatgattgtagaacctaattatgatttagatgattctggagatatttcttctacagtaattaatttttctcaaaaatatttatatggaattgattcttgtgtaaataaagtaattatttctcctaatatttatacagatgaaattaatattacacctatttatgaagctaataatacatatcctgaagtaattgtacttgatacaaactatatttctgaaaaaattaacattaacattaacgatctttctattcgttatgtatggtctaatgatggatctgattttattttaatgtctacagatgaagaaaataaagtatctcaagtaaaaattcgttttacaaatgtatttaaaggaaatacaatttctgataaaatttcttttaatttttctgataaacaagatgtatctattaataaagtaatttctacatttacaccttcttattatgtagaaggacttcttaactatgatcttggtcttatttctttatataatgaaaaattttatattaacaattttggaatgatggtatctggattagtatatattaatgattctttatattattttaaacctcctattaaaaatttaattacaggatttacaacaattggagatgataaatattattttaatcctgataacggaggagctgcttctgtaggagaaacaattattgatggaaaaaactattatttttctcaaaacggagtacttcaaacaggagtattttctacagaagatggatttaaatattttgctcctgctgatacacttgatgaaaatctagagggagaagctattgattttacgggaaagttgacaattgatgaaaacgtatattattttggagataactatcgtgctgctattgaatggcaaacacttgatgatgaagtatattatttttctacagatacaggacgtgcttttaaaggattaaatcaaattggagatgataaattttattttaattctgatggaattatgcaaaaaggatttgtaaacattaacgataaaacattttattttgatgattctggagtaatgaaatctggatatacagaaattgatggaaaatatttttattttgcagaaaatggagaaatgcaaattggagtatttaacacagctgatggttttaaatattttgctcatcatgatgaagatcttggaaatgaagagggagaagctctttcatattctggaattcttaactttaataacaaaatttattattttgatgattcttttacagctgtagtaggatggaaagatcttgaagatggatctaaatattattttgatgaagatacagctgaagcatacattggaatttctattattaacgatggaaaatattattttaacgattctggaattatgcaaattggatttgtaacaattaataatgaagtattttatttttctgattctggaattgtagaatctggaatgcaaaatattgatgataattatttttatattgatgaaaatggattagtacaaattggagtatttgatacatctgatggatataaatattttgcaccagctaacacagtaaacgataacatttatggacaagctgtagaatattctggacttgtacgtgtaggagaagatgtatattattttggagaaacatatacaattgaaacaggatggatttatgatatggaaaatgaatctgataaatattattttgatcctgaaacaaaaaaggcttacaaaggaattaacgtaattgatgatatcaagtattattttgatgaaaacggaattatgcgtacaggattaattacatttgaagataatcattattattttaatgaagatggaattatgcaatatggatatttaaatattgaagataaaacgttttatttttcagaagatggtattatgcaaattggtgtttttaatacacctgacggttttaaatattttgcacatcaaaacacacttgatgaaaactttgagggagaatctattaactatacaggatggcttgatcttgatgaaaaacgttattattttacagatgaatatattgctgctacaggatctgtaattattgatggagaagaatattattttgatccagatacagctcaattagtaatttctgag

SEQ ID NO: 35 - DNA, 10 bp, Artificial Sequence
  Oligonucleotide primer
agcggccgct

SEQ ID NO: 36 - DNA, 14 bp, Artificial Sequence
  Oligonucleotide primer
tcgccggcgacatg

SEQ ID NO: 37 - protein, 430 aa, Artificial Sequence
  His-tagged CDTa
MMVCNTTYKAPIERPEDFLKDKEKAKEWERKEAERIEQKLERSEKEALESYKKDSVEISKYSQTRNYFYDYQIEANSREKEYKELRNAISKNKIDKPMYVYYFESPEKFAFNKVIRTENQNEISLEKFNEFKETIQNKLFKQDGFKDISLYEPGKGDEKPTPLLMHLKLPRNTGMLPYTNTNNVSTLIEQGYSIKIDKIVRIVIDGKHYIKAEASVVSSLDFKDDVSKGDSWGKANYNDWSNKLTPNELADVNDYMRGGYTAINNYLISNGPVNNPNPELDSKITNIENALKREPIPTNLTVYRRSGPQEFGLTLTSPEYDFNKLENIDAFKSKWEGQALSYPNFISTSIGSVNMSAFAKRKIVLRITIPKGSPGAYLSAIPGYAGEYEVLLNHGSKFKINKIDSYKDGTITKLIVDATLIPLEHHHHHH

SEQ ID NO: 38 - protein, 420 aa, Clostridium difficile
VCNTTYKAPIERPEDFLKDKEKAKEWERKEAERIEQKLERSEKEALESYKKDSVEISKYSQTRNYFYDYQIEANSREKEYKELRNAISKNKIDKPMYVYYFESPEKFAFNKVIRTENQNEISLEKFNEFKETIQNKLFKQDGFKDISLYEPGKGDEKPTPLLMHLKLPRNTGMLPYTNTNNVSTLIEQGYSIKIDKIVRIVIDGKHYIKAEASVVSSLDFKDDVSKGDSWGKANYNDWSNKLTPNELADVNDYMRGGYTAINNYLISNGPVNNPNPELDSKITNIENALKREPIPTNLTVYRRSGPQEFGLTLTSPEYDFNKLENIDAFKSKWEGQALSYPNFISTSIGSVNMSAFAKRKIVLRITIPKGSPGAYLSAIPGYAGEYEVLLNHGSKFKINKIDSYKDGTITKLIVDATLIP

SEQ ID NO: 39 - protein, 429 aa, Artificial Sequence
  His-tagged 3mCDTa1 ( R302A, E385A, E387D)
MVCNTTYKAPIERPEDFLKDKEKAKEWERKEAERIEQKLERSEKEALESYKKDSVEISKYSQTRNYFYDYQIEANSREKEYKELRNAISKNKIDKPMYVYYFESPEKFAFNKVIRTENQNEISLEKFNEFKETIQNKLFKQDGFKDISLYEPGKGDEKPTPLLMHLKLPRNTGMLPYTNTNNVSTLIEQGYSIKIDKIVRIVIDGKHYIKAEASVVSSLDFKDDVSKGDSWGKANYNDWSNKLTPNELADVNDYMRGGYTAINNYLISNGPVNNPNPELDSKITNIENALKREPIPTNLTVYARSGPQEFGLTLTSPEYDFNKLENIDAFKSKWEGQALSYPNFISTSIGSVNMSAFAKRKIVLRITIPKGSPGAYLSAIPGYAGAYDVLLNHGSKFKINKIDSYKDGTITKLIVDATLIPLEHHHHHH

SEQ ID NO: 40 - protein, 420 aa, Artificial Sequence
  3mCDTa1 (R302A, E385A, E387D)
VCNTTYKAPIERPEDFLKDKEKAKEWERKEAERIEQKLERSEKEALESYKKDSVEISKYSQTRNYFYDYQIEANSREKEYKELRNAISKNKIDKPMYVYYFESPEKFAFNKVIRTENQNEISLEKFNEFKETIQNKLFKQDGFKDISLYEPGKGDEKPTPLLMHLKLPRNTGMLPYTNTNNVSTLIEQGYSIKIDKIVRIVIDGKHYIKAEASVVSSLDFKDDVSKGDSWGKANYNDWSNKLTPNELADVNDYMRGGYTAINNYLISNGPVNNPNPELDSKITNIENALKREPIPTNLTVYARSGPQEFGLTLTSPEYDFNKLENIDAFKSKWEGQALSYPNFISTSIGSVNMSAFAKRKIVLRITIPKGSPGAYLSAIPGYAGAYDVLLNHGSKFKINKIDSYKDGTITKLIVDATLIP

SEQ ID NO: 41 - protein, 429 aa, Artificial Sequence
  His-tagged 3mCDTa2 (S345F, E385Q, E387Q)
MVCNTTYKAPIERPEDFLKDKEKAKEWERKEAERIEQKLERSEKEALESYKKDSVEISKYSQTRNYFYDYQIEANSREKEYKELRNAISKNKIDKPMYVYYFESPEKFAFNKVIRTENQNEISLEKFNEFKETIQNKLFKQDGFKDISLYEPGKGDEKPTPLLMHLKLPRNTGMLPYTNTNNVSTLIEQGYSIKIDKIVRIVIDGKHYIKAEASVVSSLDFKDDVSKGDSWGKANYNDWSNKLTPNELADVNDYMRGGYTAINNYLISNGPVNNPNPELDSKITNIENALKREPIPTNLTVYRRSGPQEFGLTLTSPEYDFNKLENIDAFKSKWEGQALSYPNFIFTSIGSVNMSAFAKRKIVLRITIPKGSPGAYLSAIPGYAGQYQVLLNHGSKFKINKIDSYKDGTITKLIVDATLIPLEHHHHHH

SEQ ID NO: 42 - protein, 420 aa, Artificial Sequence
  3mCDTa2 (S345F, E385Q, E387Q)
VCNTTYKAPIERPEDFLKDKEKAKEWERKEAERIEQKLERSEKEALESYKKDSVEISKYSQTRNYFYDYQIEANSREKEYKELRNAISKNKIDKPMYVYYFESPEKFAFNKVIRTENQNEISLEKFNEFKETIQNKLFKQDGFKDISLYEPGKGDEKPTPLLMHLKLPRNTGMLPYTNTNNVSTLIEQGYSIKIDKIVRIVIDGKHYIKAEASVVSSLDFKDDVSKGDSWGKANYNDWSNKLTPNELADVNDYMRGGYTAINNYLISNGPVNNPNPELDSKITNIENALKREPIPTNLTVYRRSGPQEFGLTLTSPEYDFNKLENIDAFKSKWEGQALSYPNFIFTSIGSVNMSAFAKRKIVLRITIPKGSPGAYLSAIPGYAGQYQVLLNHGSKFKINKIDSYKDGTITKLIVDATLIP

SEQ ID NO: 43 - protein, 837 aa, Artificial Sequence
  proCDTb + restriction site (delta signal peptide)
LGSEIVNEDILPNNGLMGYYFTDEHFKDLKLMAPIKDGNLKFEEKKVDKLLDKDKSDVKSIRWTGRIIPSKDGEYTLSTDRDDVLMQVNTESTISNTLKVNMKKGKEYKVRIELQDKNLGSIDNLSSPNLYWELDGMKKIIPEENLFLRDYSNIEKDDPFIPNNNFFDPKLMSDWEDEDLDTDNDNIPDSYERNGYTIKDLIAVKWEDSFAEQGYKKYVSNYLESNTAGDPYTDYEKASGSFDKAIKTEARDPLVAAYPIVGVGMEKLIISTNEHASTDQGKTVSRATTNSKTESNTAGVSVNVGYQNGFTANVTTNYSHTTDNSTAVQDSNGESWNTGLSINKGESAYINANVRYYNTGTAPMYKVTPTTNLVLDGDTLSTIKAQENQIGNNLSPGDTYPKKGLSPLALNTMDQFSSRLIPINYDQLKKLDAGKQIKLETTQVSGNFGTKNSSGQIVTEGNSWSDYISQIDSISASIILDTENESYERRVTAKNLQDPEDKTPELTIGEAIEKAFGATKKDGLLYFNDIPIDESCVELIFDDNTANKIKDSLKTLSDKKIYNVKLERGMNILIKTPTYFTNFDDYNNYPSTWSNVNTTNQDGLQGSANKLNGETKIKIPMSELKPYKRYVFSGYSKDPLTSNSIIVKIKAKEEKTDYLVPEQGYTKFSYEFETTEKDSSNIEITLIGSGTTYLDNLSITELNSTPEILDEPEVKIPTDQEIMDAHKIYFADLNFNPSTGNTYINGMYFAPTQTNKEALDYIQKYRVEATLQYSGFKDIGTKDKEMRNYLGDPNQPKTNYVNLRSYFTGGENIMTYKKLRIYAITPDDRELLVLSVD

SEQ ID NO: 44 - protein, 834 aa, Artificial Sequence
  proCDTb (delta signal peptide)
EIVNEDILPNNGLMGYYFTDEHFKDLKLMAPIKDGNLKFEEKKVDKLLDKDKSDVKSIRWTGRIIPSKDGEYTLSTDRDDVLMQVNTESTISNTLKVNMKKGKEYKVRIELQDKNLGSIDNLSSPNLYWELDGMKKIIPEENLFLRDYSNIEKDDPFIPNNNFFDPKLMSDWEDEDLDTDNDNIPDSYERNGYTIKDLIAVKWEDSFAEQGYKKYVSNYLESNTAGDPYTDYEKASGSFDKAIKTEARDPLVAAYPIVGVGMEKLIISTNEHASTDQGKTVSRATTNSKTESNTAGVSVNVGYQNGFTANVTTNYSHTTDNSTAVQDSNGESWNTGLSINKGESAYINANVRYYNTGTAPMYKVTPTTNLVLDGDTLSTIKAQENQIGNNLSPGDTYPKKGLSPLALNTMDQFSSRLIPINYDQLKKLDAGKQIKLETTQVSGNFGTKNSSGQIVTEGNSWSDYISQIDSISASIILDTENESYERRVTAKNLQDPEDKTPELTIGEAIEKAFGATKKDGLLYFNDIPIDESCVELIFDDNTANKIKDSLKTLSDKKIYNVKLERGMNILIKTPTYFTNFDDYNNYPSTWSNVNTTNQDGLQGSANKLNGETKIKIPMSELKPYKRYVFSGYSKDPLTSNSIIVKIKAKEEKTDYLVPEQGYTKFSYEFETTEKDSSNIEITLIGSGTTYLDNLSITELNSTPEILDEPEVKIPTDQEIMDAHKIYFADLNFNPSTGNTYINGMYFAPTQTNKEALDYIQKYRVEATLQYSGFKDIGTKDKEMRNYLGDPNQPKTNYVNLRSYFTGGENIMTYKKLRIYAITPDDRELLVLSVD

SEQ ID NO: 45 - protein, 670 aa, Artificial Sequence
  CDTb + restriction site (delta signal peptide, delta activation domain)
LGSLMSDWEDEDLDTDNDNIPDSYERNGYTIKDLIAVKWEDSFAEQGYKKYVSNYLESNTAGDPYTDYEKASGSFDKAIKTEARDPLVAAYPIVGVGMEKLIISTNEHASTDQGKTVSRATTNSKTESNTAGVSVNVGYQNGFTANVTTNYSHTTDNSTAVQDSNGESWNTGLSINKGESAYINANVRYYNTGTAPMYKVTPTTNLVLDGDTLSTIKAQENQIGNNLSPGDTYPKKGLSPLALNTMDQFSSRLIPINYDQLKKLDAGKQIKLETTQVSGNFGTKNSSGQIVTEGNSWSDYISQIDSISASIILDTENESYERRVTAKNLQDPEDKTPELTIGEAIEKAFGATKKDGLLYFNDIPIDESCVELIFDDNTANKIKDSLKTLSDKKIYNVKLERGMNILIKTPTYFTNFDDYNNYPSTWSNVNTTNQDGLQGSANKLNGETKIKIPMSELKPYKRYVFSGYSKDPLTSNSIIVKIKAKEEKTDYLVPEQGYTKFSYEFETTEKDSSNIEITLIGSGTTYLDNLSITELNSTPEILDEPEVKIPTDQEIMDAHKIYFADLNFNPSTGNTYINGMYFAPTQTNKEALDYIQKYRVEATLQYSGFKDIGTKDKEMRNYLGDPNQPKTNYVNLRSYFTGGENIMTYKKLRIYAITPDDRELLVLSVD

SEQ ID NO: 46 - protein, 667 aa, Artificial Sequence
  CDTb (delta signal peptide, delta activation domain)
LMSDWEDEDLDTDNDNIPDSYERNGYTIKDLIAVKWEDSFAEQGYKKYVSNYLESNTAGDPYTDYEKASGSFDKAIKTEARDPLVAAYPIVGVGMEKLIISTNEHASTDQGKTVSRATTNSKTESNTAGVSVNVGYQNGFTANVTTNYSHTTDNSTAVQDSNGESWNTGLSINKGESAYINANVRYYNTGTAPMYKVTPTTNLVLDGDTLSTIKAQENQIGNNLSPGDTYPKKGLSPLALNTMDQFSSRLIPINYDQLKKLDAGKQIKLETTQVSGNFGTKNSSGQIVTEGNSWSDYISQIDSISASIILDTENESYERRVTAKNLQDPEDKTPELTIGEAIEKAFGATKKDGLLYFNDIPIDESCVELIFDDNTANKIKDSLKTLSDKKIYNVKLERGMNILIKTPTYFTNFDDYNNYPSTWSNVNTTNQDGLQGSANKLNGETKIKIPMSELKPYKRYVFSGYSKDPLTSNSIIVKIKAKEEKTDYLVPEQGYTKFSYEFETTEKDSSNIEITLIGSGTTYLDNLSITELNSTPEILDEPEVKIPTDQEIMDAHKIYFADLNFNPSTGNTYINGMYFAPTQTNKEALDYIQKYRVEATLQYSGFKDIGTKDKEMRNYLGDPNQPKTNYVNLRSYFTGGENIMTYKKLRIYAITPDDRELLVLSVD

SEQ ID NO: 47 - DNA, 1293 bp, Artificial Sequence
  E. coli optimized CdtA + His tag
atgatggtgtgcaacaccacgtataaagccccgatcgaacgtccggaagattttctgaaagataaagaaaaagcgaaagaatgggaacgtaaagaagccgaacgcattgaacagaaactggaacgttctgaaaaagaagcactggaatcttacaaaaaagatagtgttgaaatctctaaatacagtcagacccgcaactacttctacgattaccagatcgaagcgaattctcgtgaaaaagaatacaaagaactgcgcaacgccatcagtaaaaacaaaatcgataaaccgatgtatgtgtattacttcgaaagtccggaaaaattcgcgttcaacaaagttatccgcaccgaaaaccagaacgaaatctctctggaaaaattcaacgaattcaaagaaacgatccagaacaaactgttcaaacaggatggcttcaaagatattagcctgtatgaaccgggcaaaggtgatgaaaaaccgaccccgctgctgatgcatctgaaactgccgcgtaacacgggtatgctgccgtacaccaatacgaacaatgttagtaccctgattgaacagggctatagcattaaaatcgataaaatcgtgcgcatcgttatcgatggtaaacactacatcaaagcggaagccagcgtggttagctctctggattttaaagatgatgttagcaaaggcgattcttggggtaaagcgaactataatgattggagcaacaaactgaccccgaatgaactggccgatgtgaacgattacatgcgtggcggttatacggcaattaacaattacctgatcagcaacggcccggttaacaatccgaatccggaactggattctaaaattaccaacatcgaaaatgccctgaaacgcgaaccgatcccgaccaatctgacggtgtaccgtcgcagtggcccgcaggaatttggtctgaccctgacgagcccggaatacgatttcaacaaactggaaaacatcgatgcattcaaatctaaatgggaaggccaggcgctgagttatccgaactttattagtaccagcatcggtagtgtgaatatgagcgcattcgcgaaacgtaaaatcgttctgcgcattacgatcccgaaaggcagcccgggtgcctacctgtctgcaattccgggctacgccggtgaatatgaagtgctgctgaaccatggcagcaaattcaaaatcaacaaaatcgattcttacaaagatggtaccattacgaaactgatcgttgatgcgaccctgattccgctcgagcaccaccaccaccaccactga

SEQ ID NO: 48 - DNA, 1266 bp, Artificial Sequence
  E. coli optimized CdtA
atgatggtgtgcaacaccacgtataaagccccgatcgaacgtccggaagattttctgaaagataaagaaaaagcgaaagaatgggaacgtaaagaagccgaacgcattgaacagaaactggaacgttctgaaaaagaagcactggaatcttacaaaaaagatagtgttgaaatctctaaatacagtcagacccgcaactacttctacgattaccagatcgaagcgaattctcgtgaaaaagaatacaaagaactgcgcaacgccatcagtaaaaacaaaatcgataaaccgatgtatgtgtattacttcgaaagtccggaaaaattcgcgttcaacaaagttatccgcaccgaaaaccagaacgaaatctctctggaaaaattcaacgaattcaaagaaacgatccagaacaaactgttcaaacaggatggcttcaaagatattagcctgtatgaaccgggcaaaggtgatgaaaaaccgaccccgctgctgatgcatctgaaactgccgcgtaacacgggtatgctgccgtacaccaatacgaacaatgttagtaccctgattgaacagggctatagcattaaaatcgataaaatcgtgcgcatcgttatcgatggtaaacactacatcaaagcggaagccagcgtggttagctctctggattttaaagatgatgttagcaaaggcgattcttggggtaaagcgaactataatgattggagcaacaaactgaccccgaatgaactggccgatgtgaacgattacatgcgtggcggttatacggcaattaacaattacctgatcagcaacggcccggttaacaatccgaatccggaactggattctaaaattaccaacatcgaaaatgccctgaaacgcgaaccgatcccgaccaatctgacggtgtaccgtcgcagtggcccgcaggaatttggtctgaccctgacgagcccggaatacgatttcaacaaactggaaaacatcgatgcattcaaatctaaatgggaaggccaggcgctgagttatccgaactttattagtaccagcatcggtagtgtgaatatgagcgcattcgcgaaacgtaaaatcgttctgcgcattacgatcccgaaaggcagcccgggtgcctacctgtctgcaattccgggctacgccggtgaatatgaagtgctgctgaaccatggcagcaaattcaaaatcaacaaaatcgattcttacaaagatggtaccattacgaaactgatcgttgatgcgaccctgattccg

SEQ ID NO: 49 - DNA, 1290 bp, Artificial Sequence
  E. coli optimized 3mcdtA1 + His tag
atggtctgcaacacaacctacaaagcccctattgaacgccctgaagattttctgaaagataaagaaaaagctaaagaatgggaacgcaaagaagcggaacgtattgaacaaaaattagaacgcagcgaaaaagaagcccttgaatcttacaaaaaagatagcgtagaaatctccaaatactctcaaacccgtaactacttttacgattaccagatcgaagcaaactctcgtgaaaaagaatacaaagaactgcgcaacgctatcagcaaaaacaaaatcgataaacctatgtacgtatactactttgaatctccagaaaaatttgcgtttaacaaagtcatccgcacggaaaatcaaaacgaaatcagcttagaaaaatttaacgaatttaaagaaactatccaaaacaaactttttaaacaggatggctttaaagatatctcactgtatgaaccgggaaaaggtgatgaaaaaccgacgcctctgcttatgcatcttaaacttccacgtaacactggaatgttaccgtacacaaacaccaataacgtatccacgcttattgaacagggatactctatcaaaatcgataaaatcgtacgcatcgtcatcgatggtaaacactacatcaaagcagaagcttcagttgtgtctagcctggattttaaagatgatgtcagcaaaggagattcatggggtaaagctaactacaacgattggagtaacaaacttacaccaaacgaactggcggatgttaatgattacatgcgtggtggctataccgccattaataactatctgatctcaaatggtccggtgaataacccaaacccggaacttgatagtaaaatcactaacatcgaaaacgcactgaaacgtgaacctattccaacaaatttaaccgtttacgctcgcagtggcccgcaagaatttggactgacgcttacttcccctgaatacgattttaacaaactggaaaacatcgatgcatttaaaagcaaatgggagggtcaggctctttcataccctaactttatctcaacaagtatcggcagtgttaacatgtccgcgtttgccaaacgtaaaattgtgcttcgcattaccatcccgaaaggctcacctggagcgtatttaagtgccattccgggttacgcaggcgcttatgatgtgcttctgaatcatggctctaaatttaaaattaacaaaattgattcatacaaagatggcactattaccaaacttatcgttgatgctacacttatcccactcgagcaccaccaccaccaccactga

SEQ ID NO: 50 - DNA, 1263 bp, Artificial Sequence
  E. coli optimized 3mcdtA1
atggtctgcaacacaacctacaaagcccctattgaacgccctgaagattttctgaaagataaagaaaaagctaaagaatgggaacgcaaagaagcggaacgtattgaacaaaaattagaacgcagcgaaaaagaagcccttgaatcttacaaaaaagatagcgtagaaatctccaaatactctcaaacccgtaactacttttacgattaccagatcgaagcaaactctcgtgaaaaagaatacaaagaactgcgcaacgctatcagcaaaaacaaaatcgataaacctatgtacgtatactactttgaatctccagaaaaatttgcgtttaacaaagtcatccgcacggaaaatcaaaacgaaatcagcttagaaaaatttaacgaatttaaagaaactatccaaaacaaactttttaaacaggatggctttaaagatatctcactgtatgaaccgggaaaaggtgatgaaaaaccgacgcctctgcttatgcatcttaaacttccacgtaacactggaatgttaccgtacacaaacaccaataacgtatccacgcttattgaacagggatactctatcaaaatcgataaaatcgtacgcatcgtcatcgatggtaaacactacatcaaagcagaagcttcagttgtgtctagcctggattttaaagatgatgtcagcaaaggagattcatggggtaaagctaactacaacgattggagtaacaaacttacaccaaacgaactggcggatgttaatgattacatgcgtggtggctataccgccattaataactatctgatctcaaatggtccggtgaataacccaaacccggaacttgatagtaaaatcactaacatcgaaaacgcactgaaacgtgaacctattccaacaaatttaaccgtttacgctcgcagtggcccgcaagaatttggactgacgcttacttcccctgaatacgattttaacaaactggaaaacatcgatgcatttaaaagcaaatgggagggtcaggctctttcataccctaactttatctcaacaagtatcggcagtgttaacatgtccgcgtttgccaaacgtaaaattgtgcttcgcattaccatcccgaaaggctcacctggagcgtatttaagtgccattccgggttacgcaggcgcttatgatgtgcttctgaatcatggctctaaatttaaaattaacaaaattgattcatacaaagatggcactattaccaaacttatcgttgatgctacacttatccca

SEQ ID NO: 51 - DNA, 1290 bp, Artificial Sequence
  E. coli optimized 3mcdtA2 + His tag
atggtctgcaacacaacctacaaagcccctattgaacgccctgaagattttctgaaagataaagaaaaagctaaagaatgggaacgcaaagaagcggaacgtattgaacaaaaattagaacgcagcgaaaaagaagcccttgaatcttacaaaaaagatagcgtagaaatctccaaatactctcaaacccgtaactacttttacgattaccagatcgaagcaaactctcgtgaaaaagaatacaaagaactgcgcaacgctatcagcaaaaacaaaatcgataaacctatgtacgtatactactttgaatctccagaaaaatttgcgtttaacaaagtcatccgcacggaaaatcaaaacgaaatcagcttagaaaaatttaacgaatttaaagaaactatccaaaacaaactttttaaacaggatggctttaaagatatctcactgtatgaaccgggaaaaggtgatgaaaaaccgacgcctctgcttatgcatcttaaacttccacgtaacactggaatgttaccgtacacaaacaccaataacgtatccacgcttattgaacagggatactctatcaaaatcgataaaatcgtacgcatcgtcatcgatggtaaacactacatcaaagcagaagcttcagttgtgtctagcctggattttaaagatgatgtcagcaaaggagattcatggggtaaagctaactacaacgattggagtaacaaacttacaccaaacgaactggcggatgttaatgattacatgcgtggtggctataccgccattaataactatctgatctcaaatggtccggtgaataacccaaacccggaacttgatagtaaaatcactaacatcgaaaacgcactgaaacgtgaacctattccaacaaatttaaccgtttaccgtcgcagtggcccgcaagaatttggactgacgcttacttcccctgaatacgattttaacaaactggaaaacatcgatgcatttaaaagcaaatgggagggtcaggctctttcataccctaactttatctttacaagtatcggcagtgttaacatgtccgcgtttgccaaacgtaaaattgtgcttcgcattaccatcccgaaaggctcacctggagcgtatttaagtgccattccgggttacgcaggccaatatcaagtgcttctgaatcatggctctaaatttaaaattaacaaaattgattcatacaaagatggcactattaccaaacttatcgttgatgctacacttatcccactcgagcaccaccaccaccaccactga

SEQ ID NO: 52 - DNA, 1263 bp, Artificial Sequence
  E. coli optimized 3mcdtA2
atggtctgcaacacaacctacaaagcccctattgaacgccctgaagattttctgaaagataaagaaaaagctaaagaatgggaacgcaaagaagcggaacgtattgaacaaaaattagaacgcagcgaaaaagaagcccttgaatcttacaaaaaagatagcgtagaaatctccaaatactctcaaacccgtaactacttttacgattaccagatcgaagcaaactctcgtgaaaaagaatacaaagaactgcgcaacgctatcagcaaaaacaaaatcgataaacctatgtacgtatactactttgaatctccagaaaaatttgcgtttaacaaagtcatccgcacggaaaatcaaaacgaaatcagcttagaaaaatttaacgaatttaaagaaactatccaaaacaaactttttaaacaggatggctttaaagatatctcactgtatgaaccgggaaaaggtgatgaaaaaccgacgcctctgcttatgcatcttaaacttccacgtaacactggaatgttaccgtacacaaacaccaataacgtatccacgcttattgaacagggatactctatcaaaatcgataaaatcgtacgcatcgtcatcgatggtaaacactacatcaaagcagaagcttcagttgtgtctagcctggattttaaagatgatgtcagcaaaggagattcatggggtaaagctaactacaacgattggagtaacaaacttacaccaaacgaactggcggatgttaatgattacatgcgtggtggctataccgccattaataactatctgatctcaaatggtccggtgaataacccaaacccggaacttgatagtaaaatcactaacatcgaaaacgcactgaaacgtgaacctattccaacaaatttaaccgtttaccgtcgcagtggcccgcaagaatttggactgacgcttacttcccctgaatacgattttaacaaactggaaaacatcgatgcatttaaaagcaaatgggagggtcaggctctttcataccctaactttatctttacaagtatcggcagtgttaacatgtccgcgtttgccaaacgtaaaattgtgcttcgcattaccatcccgaaaggctcacctggagcgtatttaagtgccattccgggttacgcaggccaatatcaagtgcttctgaatcatggctctaaatttaaaattaacaaaattgattcatacaaagatggcactattaccaaacttatcgttgatgctacacttatccca

SEQ ID NO: 53 - DNA, 2004 bp, Artificial Sequence
  E. coli optimized cdtB
ctgatgtcggactgggaagatgaagacctggataccgacaacgataatattccggatagctatgaacgtaacggttacaccatcaaagacctgattgcagtgaaatgggaagatagctttgctgaacagggctacaaaaaatacgtttcgaactacctggaaagcaataccgcaggtgacccgtatacggattacgaaaaagctagcggctctttcgacaaagcaattaaaaccgaagctcgtgatccgctggttgcggcctatccgatcgtgggcgttggtatggaaaaactgattatctccaccaatgaacatgcgtcaaccgatcagggtaaaacggtctcccgcgccaccacgaactctaaaaccgaaagtaatacggcaggcgtctcagtgaacgttggctatcagaatggttttaccgctaacgtcaccacgaattactcgcacaccacggacaacagcaccgcggtgcaagattccaacggcgaatcatggaatacgggtctgtctattaataaaggcgaaagtgcgtatatcaacgccaatgttcgttattacaacaccggtacggctccgatgtacaaagttaccccgaccacgaatctggtcctggacggcgataccctgtccacgattaaagcgcaggaaaaccaaatcggtaacaatctgtcgccgggcgacacctatccgaaaaaaggtctgagcccgctggccctgaacaccatggatcagtttagctctcgcctgattccgatcaattatgaccaactgaaaaaactggatgcaggcaaacagattaaactggaaaccacgcaagtttctggcaacttcggtaccaaaaatagttccggtcagatcgtcacggaaggcaacagttggtccgactatatttctcaaatcgattcaatttcggccagcattatcctggataccgaaaacgaaagttacgaacgtcgcgtgacggcaaaaaatctgcaggacccggaagataaaaccccggaactgacgatcggtgaagctattgaaaaagcatttggtgctaccaaaaaagatggcctgctgtatttcaatgacattccgatcgatgaaagctgcgtcgaactgatttttgatgacaacaccgccaataaaatcaaagactctctgaaaacgctgagtgataagaaaatttacaacgtgaaactggaacgtggcatgaatattctgatcaaaaccccgacgtactttaccaacttcgatgactataacaattacccgtccacgtggtcaaacgttaataccacgaatcaggatggcctgcaaggttctgcaaacaaactgaacggtgaaaccaaaatcaaaatcccgatgagtgaactgaaaccgtataaacgctacgtgttctcgggctatagcaaagatccgctgacctctaacagtatcatcgtgaaaatcaaagcgaaagaagaaaaaaccgattacctggttccggaacagggttatacgaaattttcctacgaattcgaaaccacggaaaaagattcatcgaatattgaaatcaccctgatcggctcaggtaccacgtatctggacaacctgtccattaccgaactgaattcaacgccggaaatcctggatgaaccggaagtgaaaatcccgaccgaccaggaaatcatggatgcgcataaaatctacttcgccgatctgaacttcaatccgtctaccggtaacacgtatattaatggcatgtactttgcgccgacccaaacgaacaaagaagccctggattatattcagaaataccgcgttgaagccaccctgcaatatagcggcttcaaagacatcggtacgaaagataaagaaatgcgtaactacctgggcgatccgaatcagccgaaaaccaactatgtgaatctgcgcagttactttaccggcggtgaaaacatcatgacgtacaaaaaactgcgtatctacgcgattaccccggatgaccgcgaactgctggtcctgagcgtggattaa

SEQ ID NO: 54 - DNA, 2697 bp, Artificial Sequence
  E. coli optimized GST-cdtB
atgtcccctatactaggttattggaaaattaagggccttgtgcaacccactcgacttcttttggaatatcttgaagaaaaatatgaagagcatttgtatgagcgcgatgaaggtgataaatggcgaaacaaaaagtttgaattgggtttggagtttcccaatcttccttattatattgatggtgatgttaaattaacacagtctatggccatcatacgttatatagctgacaagcacaacatgttgggtggttgtccaaaagagcgtgcagagatttcaatgcttgaaggagcggttttggatattagatacggtgtttcgagaattgcatatagtaaagactttgaaactctcaaagttgattttcttagcaagctacctgaaatgctgaaaatgttcgaagatcgtttatgtcataaaacatatttaaatggtgatcatgtaacccatcctgacttcatgttgtatgacgctcttgatgttgttttatacatggacccaatgtgcctggatgcgttcccaaaattagtttgttttaaaaaacgtattgaagctatcccacaaattgataagtacttgaaatccagcaagtatatagcatggcctttgcagggctggcaagccacgtttggtggtggcgaccatcctccaaaatcggatctggaagttctgttccaggggcccctgggatccctgatgtcggactgggaagatgaagacctggataccgacaacgataatattccggatagctatgaacgtaacggttacaccatcaaagacctgattgcagtgaaatgggaagatagctttgctgaacagggctacaaaaaatacgtttcgaactacctggaaagcaataccgcaggtgacccgtatacggattacgaaaaagctagcggctctttcgacaaagcaattaaaaccgaagctcgtgatccgctggttgcggcctatccgatcgtgggcgttggtatggaaaaactgattatctccaccaatgaacatgcgtcaaccgatcagggtaaaacggtctcccgcgccaccacgaactctaaaaccgaaagtaatacggcaggcgtctcagtgaacgttggctatcagaatggttttaccgctaacgtcaccacgaattactcgcacaccacggacaacagcaccgcggtgcaagattccaacggcgaatcatggaatacgggtctgtctattaataaaggcgaaagtgcgtatatcaacgccaatgttcgttattacaacaccggtacggctccgatgtacaaagttaccccgaccacgaatctggtcctggacggcgataccctgtccacgattaaagcgcaggaaaaccaaatcggtaacaatctgtcgccgggcgacacctatccgaaaaaaggtctgagcccgctggccctgaacaccatggatcagtttagctctcgcctgattccgatcaattatgaccaactgaaaaaactggatgcaggcaaacagattaaactggaaaccacgcaagtttctggcaacttcggtaccaaaaatagttccggtcagatcgtcacggaaggcaacagttggtccgactatatttctcaaatcgattcaatttcggccagcattatcctggataccgaaaacgaaagttacgaacgtcgcgtgacggcaaaaaatctgcaggacccggaagataaaaccccggaactgacgatcggtgaagctattgaaaaagcatttggtgctaccaaaaaagatggcctgctgtatttcaatgacattccgatcgatgaaagctgcgtcgaactgatttttgatgacaacaccgccaataaaatcaaagactctctgaaaacgctgagtgataagaaaatttacaacgtgaaactggaacgtggcatgaatattctgatcaaaaccccgacgtactttaccaacttcgatgactataacaattacccgtccacgtggtcaaacgttaataccacgaatcaggatggcctgcaaggttctgcaaacaaactgaacggtgaaaccaaaatcaaaatcccgatgagtgaactgaaaccgtataaacgctacgtgttctcgggctatagcaaagatccgctgacctctaacagtatcatcgtgaaaatcaaagcgaaagaagaaaaaaccgattacctggttccggaacagggttatacgaaattttcctacgaattcgaaaccacggaaaaagattcatcgaatattgaaatcaccctgatcggctcaggtaccacgtatctggacaacctgtccattaccgaactgaattcaacgccggaaatcctggatgaaccggaagtgaaaatcccgaccgaccaggaaatcatggatgcgcataaaatctacttcgccgatctgaacttcaatccgtctaccggtaacacgtatattaatggcatgtactttgcgccgacccaaacgaacaaagaagccctggattatattcagaaataccgcgttgaagccaccctgcaatatagcggcttcaaagacatcggtacgaaagataaagaaatgcgtaactacctgggcgatccgaatcagccgaaaaccaactatgtgaatctgcgcagttactttaccggcggtgaaaacatcatgacgtacaaaaaactgcgtatctacgcgattaccccggatgaccgcgaactgctggtcctgagcgtggattaa

SEQ ID NO: 55 - DNA, 2505 bp, Artificial Sequence
  E. coli optimized procdtB
gaaatcgtcaatgaagatattctgccaaacaatggactgatgggttactactttacggatgaacactttaaagatctgaaactgatggctcctatcaaagatggcaacctgaaatttgaagagaaaaaagtcgataaactgcttgataaagataaaagtgatgttaaatccattcgttggaccggccgcattatcccaagcaaagatggagaatatacgctttcaactgatcgtgatgatgtgctgatgcaagtaaacacagaatcaaccattagtaacacgctgaaagtgaacatgaaaaaaggaaaagaatacaaagtacgcattgaactgcaggataaaaaccttggtagtatcgataacttatctagcccgaacctttattgggaacttgatggtatgaagaaaattatccctgaagaaaacttatttcttcgtgattactctaacatcgaaaaagatgatccgtttatccctaacaacaatttctttgatccgaaacttatgagcgattgggaagatgaagatcttgataccgataacgataacatccctgattcttatgaacgcaatggatacacgatcaaagatctgattgcggtcaaatgggaagatagctttgccgaacaaggttacaaaaaatacgtttccaactacttagaatctaatacggcgggtgatccgtatactgattacgaaaaagccagtggctcctttgataaagcgattaaaacagaagcccgtgatcctcttgtcgcagcttatccaattgttggagtgggtatggaaaaactgattatcagtaccaatgaacatgcatccacggatcagggtaaaactgttagtcgcgctacaaccaactctaaaacggaaagcaatactgcgggcgtatctgtcaacgttggctatcaaaatggatttacggccaacgtcacgactaattactctcacacaaccgataacagcacggcagttcaggattcaaacggagaaagttggaatactggtctgtcaatcaacaaaggcgaaagtgcatacatcaacgctaacgtacgttactacaacacaggcaccgccccgatgtataaagtcacccctacgactaatctggttcttgatggagatacgcttagtactatcaaagcacaagaaaaccagatcggaaacaatcttagtcctggtgatacgtatccgaaaaaaggtctgtctcctcttgctctgaacacaatggatcaattttcaagtcgcctgatcccaatcaactacgatcagctgaaaaaacttgatgcgggcaaacaaattaaattagaaacaacccaggtgtctggtaactttggcacgaaaaattcctctggccaaattgtaactgaaggaaattcttggagcgattacatcagtcagatcgattcaatcagtgcttccattatcctggatacagaaaacgaatcttacgaacgtcgcgttaccgcgaaaaatctgcaagatccggaagataaaacacctgaattaaccatcggagaagccattgaaaaagcgtttggtgccaccaaaaaagatggccttctgtactttaacgatatcccgatcgatgaaagctgtgtggaacttatctttgatgataacacggctaacaaaatcaaagatagcctgaaaactctttcagataagaaaatttacaacgtaaaacttgaacgtggtatgaatattctgatcaaaacgcctacttactttacgaactttgatgattacaacaattacccatccacttggtctaacgttaatacgactaatcaagatggattacagggtagcgcgaacaaacttaacggcgaaacgaaaatcaaaatcccaatgtcagaacttaaaccgtataaacgctacgtgtttagcggatattcaaaagatccacttacatctaacagcatcatcgtgaaaatcaaagcaaaagaagaaaaaacagattatctggtaccggaacaaggctacaccaaatttagctacgaatttgaaacaaccgaaaaagatagctcaaacatcgaaatcacacttatcggctcaggaacgacttatcttgataacctgtccattacagaactgaattctacccctgaaatcttagatgaaccagaagtgaaaatcccgaccgatcaagaaatcatggatgcacataaaatctactttgctgatcttaactttaacccatcaacaggaaacacctatattaatggaatgtactttgcaccgacacagaccaacaaagaagctcttgattacatccaaaaataccgtgtggaagcaacacttcagtatagcggttttaaagatatcggcaccaaagataaagaaatgcgtaactacctgggtgatccaaaccagccgaaaacaaactacgtaaaccttcgctcatactttacaggtggcgaaaatattatgacctataaaaaacttcgtatctacgccattactcctgatgatcgtgaacttttagtcctttccgtggattaa

SEQ ID NO: 56 - DNA, 3198 bp, Artificial Sequence
  E. coli optimized GST-procdtB
atgtcccctatactaggttattggaaaattaagggccttgtgcaacccactcgacttcttttggaatatcttgaagaaaaatatgaagagcatttgtatgagcgcgatgaaggtgataaatggcgaaacaaaaagtttgaattgggtttggagtttcccaatcttccttattatattgatggtgatgttaaattaacacagtctatggccatcatacgttatatagctgacaagcacaacatgttgggtggttgtccaaaagagcgtgcagagatttcaatgcttgaaggagcggttttggatattagatacggtgtttcgagaattgcatatagtaaagactttgaaactctcaaagttgattttcttagcaagctacctgaaatgctgaaaatgttcgaagatcgtttatgtcataaaacatatttaaatggtgatcatgtaacccatcctgacttcatgttgtatgacgctcttgatgttgttttatacatggacccaatgtgcctggatgcgttcccaaaattagtttgttttaaaaaacgtattgaagctatcccacaaattgataagtacttgaaatccagcaagtatatagcatggcctttgcagggctggcaagccacgtttggtggtggcgaccatcctccaaaatcggatctggaagttctgttccaggggcccctgggatccgaaatcgtcaatgaagatattctgccaaacaatggactgatgggttactactttacggatgaacactttaaagatctgaaactgatggctcctatcaaagatggcaacctgaaatttgaagagaaaaaagtcgataaactgcttgataaagataaaagtgatgttaaatccattcgttggaccggccgcattatcccaagcaaagatggagaatatacgctttcaactgatcgtgatgatgtgctgatgcaagtaaacacagaatcaaccattagtaacacgctgaaagtgaacatgaaaaaaggaaaagaatacaaagtacgcattgaactgcaggataaaaaccttggtagtatcgataacttatctagcccgaacctttattgggaacttgatggtatgaagaaaattatccctgaagaaaacttatttcttcgtgattactctaacatcgaaaaagatgatccgtttatccctaacaacaatttctttgatccgaaacttatgagcgattgggaagatgaagatcttgataccgataacgataacatccctgattcttatgaacgcaatggatacacgatcaaagatctgattgcggtcaaatgggaagatagctttgccgaacaaggttacaaaaaatacgtttccaactacttagaatctaatacggcgggtgatccgtatactgattacgaaaaagccagtggctcctttgataaagcgattaaaacagaagcccgtgatcctcttgtcgcagcttatccaattgttggagtgggtatggaaaaactgattatcagtaccaatgaacatgcatccacggatcagggtaaaactgttagtcgcgctacaaccaactctaaaacggaaagcaatactgcgggcgtatctgtcaacgttggctatcaaaatggatttacggccaacgtcacgactaattactctcacacaaccgataacagcacggcagttcaggattcaaacggagaaagttggaatactggtctgtcaatcaacaaaggcgaaagtgcatacatcaacgctaacgtacgttactacaacacaggcaccgccccgatgtataaagtcacccctacgactaatctggttcttgatggagatacgcttagtactatcaaagcacaagaaaaccagatcggaaacaatcttagtcctggtgatacgtatccgaaaaaaggtctgtctcctcttgctctgaacacaatggatcaattttcaagtcgcctgatcccaatcaactacgatcagctgaaaaaacttgatgcgggcaaacaaattaaattagaaacaacccaggtgtctggtaactttggcacgaaaaattcctctggccaaattgtaactgaaggaaattcttggagcgattacatcagtcagatcgattcaatcagtgcttccattatcctggatacagaaaacgaatcttacgaacgtcgcgttaccgcgaaaaatctgcaagatccggaagataaaacacctgaattaaccatcggagaagccattgaaaaagcgtttggtgccaccaaaaaagatggccttctgtactttaacgatatcccgatcgatgaaagctgtgtggaacttatctttgatgataacacggctaacaaaatcaaagatagcctgaaaactctttcagataagaaaatttacaacgtaaaacttgaacgtggtatgaatattctgatcaaaacgcctacttactttacgaactttgatgattacaacaattacccatccacttggtctaacgttaatacgactaatcaagatggattacagggtagcgcgaacaaacttaacggcgaaacgaaaatcaaaatcccaatgtcagaacttaaaccgtataaacgctacgtgtttagcggatattcaaaagatccacttacatctaacagcatcatcgtgaaaatcaaagcaaaagaagaaaaaacagattatctggtaccggaacaaggctacaccaaatttagctacgaatttgaaacaaccgaaaaagatagctcaaacatcgaaatcacacttatcggctcaggaacgacttatcttgataacctgtccattacagaactgaattctacccctgaaatcttagatgaaccagaagtgaaaatcccgaccgatcaagaaatcatggatgcacataaaatctactttgctgatcttaactttaacccatcaacaggaaacacctatattaatggaatgtactttgcaccgacacagaccaacaaagaagctcttgattacatccaaaaataccgtgtggaagcaacacttcagtatagcggttttaaagatatcggcaccaaagataaagaaatgcgtaactacctgggtgatccaaaccagccgaaaacaaactacgtaaaccttcgctcatactttacaggtggcgaaaatattatgacctataaaaaacttcgtatctacgccattactcctgatgatcgtgaacttttagtcctttccgtggattaa

SEQ ID NO: 57 - DNA, 7101 bp, Artificial Sequence
  VPI strain, 5mTcdB, Bacillus megaterium codon-optimized (W102A, D288A, E515Q, W520A, C698A)
atgtcacttgtaaaccgcaaacagttggagaagatggccaacgtccgtttcagaacgcaagaggacgaatatgtggcgattctagatgcgctggaagaataccacaacatgtcagaaaacaccgttgttgagaagtacctaaaactgaaggacatcaacagcttgaccgatatctacatcgatacctacaaaaaatcgggccgcaataaggccctaaagaagtttaaggaatacttggttactgaggtgctagagctgaagaataacaacctgaccccggttgaaaagaacctgcattttgtggcgatcggcggtcagattaacgataccgcgattaactacatcaatcagtggaaagacgtaaacagcgattataacgttaacgtcttctatgattccaacgcgttcttgatcaataccctaaagaagacggttgttgagagcgcaattaacgataccctagagtcgtttcgcgagaaccttaatgaccccaggttcgactataacaagttcttccgcaaacgtatggagatcatttatgataaacaaaaaaacttcatcaactattacaaagctcagagggaagagaaccctgaattgatcatcgatgatatcgtgaagacctacttgtcgaacgaatacagcaaggagatcgatgagctgaatacgtatattgaagaaagcttgaataagattactcaaaatagcggcaacgatgtgcgtaactttgaagagtttaagaatggtgaaagcttcaacctgtatgagcaggaattggttgagcgttggaacttggccgccgcttccgacatccttcgtattagcgccctaaaggagatcggcggtatgtacctggatgtcgcgatgctgcccggaatccagccagacctgttcgaatctatcgagaaaccaagcagcgtgaccgtagatttctgggagatgaccaaactagaggctatcatgaaatacaaagagtatattccggagtatacctcggagcacttcgacatgctggatgaagaggttcagtcctcgttcgagagcgtcctggcgagcaaatcggacaagagcgagattttctctagcttgggcgacatggaggccagcccactggaggtcaaaatcgcttttaactctaagggcatcattaaccagggtctgattagcgtgaaggactcgtactgctctaatctgatcgtgaaacaaatcgagaaccgctacaagattctgaataactcgttgaatccggccatctctgaagacaacgattttaacactaccacgaacacgttcatcgattccatcatggcggaagccaacgcggataacggccgtttcatgatggagctgggtaaatacttgcgcgttggtttctttcccgacgtgaaaactactatcaacctgagcggtccggaggcatatgccgctgcgtaccaagacctgttgatgttcaaggaaggtagcatgaatattcatctgattgaagctgacctgagaaactttgagatctcgaagacgaacatcagccagagcaccgagcagcaaatggcgtccctagcttcattcgatgatgcgcgcgcaaaagcccaatttgaagagtacaagcgcaactacttcgaaggtagcctgggtgaggacgacaaccttgatttctcgcagaacatcgtcgttgataaggagtacctgctggagaagatcagctctttggcgcgctcgagcgagcgtggttacatccactacatcgttcaactacagggtgacaaaatcagctacgaggcagcctgcaatcttttcgctaaaaccccgtacgattcagtgctgtttcaaaaaaatatcgaggattccgaaatcgcttactactacaacccgggtgatggagaaattcaggagatcgataaatacaaaatcccaagcatcatttccgaccgtccgaaaatcaaactgaccttcattggtcatggtaaggacgaattcaataccgatatcttcgcaggctttgacgtggatagcctttcgaccgaaattgaggcggccatcgatctggcgaaggaagatatttctcccaagtctatcgaaatcaacctgctaggcgcgaatatgttctcctacagcatcaacgtcgaagaaacttaccccggcaaactgcttctaaaggttaaagacaaaatcagcgagctgatgccgtcaattagccaggactcgatcattgtctccgcaaaccagtatgaggttcgcatcaactctgaaggccgcagggagctactggaccatagcggtgagtggattaacaaggaggaatcgattatcaaagacatttccagcaaagagtatatctcttttaacccgaaagaaaacaagatcacggtgaaatcgaagaatctgccggagttgtctacgctgttgcaggagatccgcaacaactcgaattcaagcgacattgaacttgaggagaaggtgatgcttaccgagtgtgaaattaatgtcatttctaacattgacacccagattgtagaagagagaatcgaggaggcgaagaacctgacgagcgactcgatcaactatattaaagatgaattcaagctaattgagtccattagcgacgcgctttgcgacctgaaacagcagaatgaacttgaggacagccacttcatcagcttcgaggatatctcggagactgacgagggtttctcgatccgtttcatcaacaaagagacgggcgagtctatcttcgtggagaccgaaaaaaccatcttcagcgagtatgcaaaccacattacggaggagatctcgaaaattaaaggcaccatttttgatactgttaatggaaagctggttaagaaagtgaacctggatacgacccacgaggtgaacaccctgaacgctgctttctttatccaatcattgatcgagtataactcgtctaaagagagcctgtccaatctgtcggttgctatgaaggtgcaagtctacgcgcagctgttcagcaccggtctaaacaccattaccgatgcagccaaggttgtggaactagttagcactgccctcgacgaaactatcgacctgctaccgaccttatcggaaggtctcccgattattgctaccatcattgacggcgtttctctcggcgctgctatcaaagagctatctgaaaccagcgacccgttgctgcgccaggagatcgaagctaagattggcattatggcagtgaacctgacgaccgcgacgaccgcgatcatcacgagctctctgggcattgcttccggctttagcatcctgctcgtccctctggcaggcatctccgcaggcattccctccctggtcaataacgaactcgtcctgcgtgacaaggcgaccaaagttgttgactactttaaacacgtgagcctggtggaaaccgagggtgttttcactctgctggacgataagattatgatgcctcaagatgatctagtcatctccgaaatcgactttaacaacaactcgatcgtgctgggaaaatgcgagatttggcgcatggagggcggttctggccataccgtgacggacgatattgatcatttctttagcgcaccttctattacgtatcgtgaaccgcacctctcaatttatgacgtgctagaagttcagaaagaggagttggatctgtcaaaagacctgatggttctgccgaacgcgccgaaccgtgtgttcgcgtgggagactggttggacccctggcctacgctcgttggagaacgatggtaccaagctgctggatcgtattcgtgataattatgaaggtgagttctattggcgttattttgcatttatcgctgacgccttgattacgaccctaaagccccgctatgaagataccaatatccgtattaacctggattcgaacactcgcagcttcattgtgccgattattacgaccgagtacatccgtgagaagctgagctatagcttttatggttccggaggtacgtatgcgctgagcttgtcgcagtacaacatgggcattaatattgagctgagcgagtcagacgtttggattattgacgttgataacgttgtccgtgatgttaccattgaatctgacaagatcaagaagggcgacctgattgagggcattctctccaccttgtctattgaggaaaacaagatcattctgaactcccatgagatcaatttttcgggagaggttaacggcagcaacggttttgtgtccctgactttcagcatcctggaaggtattaacgccatcattgaggtggacctcctctctaagagctacaagctactgatctctggcgagctgaagattctgatgctcaactctaatcacattcagcagaaaattgactatatcggctttaactccgagctgcagaaaaatattccatactcctttgtggactctgagggaaaggagaacggtttcatcaatggttcgaccaaagaaggtttgtttgtttctgagttgccagatgtggtgttgattagcaaagtgtacatggacgactccaagccgtcctttggctattactccaacaatctaaaggatgtgaaggttattactaaagacaacgtgaacatcctgaccggctactatctgaaggacgacattaagatttcactgtcgctgacgctgcaggatgagaaaaccatcaaactgaactctgtacatctggatgagtctggagttgctgagatcctgaagttcatgaatcgcaagggtaacaccaacacttccgattctctgatgtcttttctggagagcatgaatatcaaaagcatctttgtgaactttttgcagtctaacattaagtttatcttggatgccaactttattatctcgggcacgacttccatcggtcaatttgagtttatctgtgacgaaaatgataacattcagccgtattttattaaatttaacactttggagaccaactacaccctgtacgttggtaatcgtcagaacatgatcgtcgagccgaactatgatctagacgattcgggtgacatcagcagcacggtgattaactttagccagaaatacctgtatggtattgactcctgtgttaacaaagtggttatttcccctaacatctataccgatgaaatcaatatcacgccggtttacgaaaccaacaacacctacccggaagttattgttctcgacgctaattatattaatgaaaagatcaacgttaacattaacgacctgagcatccgttacgtttggtcgaacgatggcaacgactttattctgatgtctacgagcgaagaaaacaaagtctcacaggttaagatccgcttcgtgaacgttttcaaagacaaaacgctggcgaacaaattgagcttcaacttcagcgataaacaggatgtcccggtcagcgagattatcttgtcgttcaccccgtcatactatgaggacggtctgattggctacgacctgggcctggttagcctgtataatgaaaagttctatattaacaactttggtatgatggttagcggcctaatctatatcaacgactccctatactacttcaaacccccggtgaacaacctgattaccggttttgtgacggtaggtgatgataaatattatttcaatccaatcaacggaggcgcggcctcgatcggtgagaccattattgatgataaaaactattatttcaatcagagcggtgttttgcagaccggtgtgttctcgaccgaggatggtttcaagtactttgcaccagccaacaccctggacgaaaacttggagggagaagcgattgactttacgggtaaactgatcatcgacgaaaacatctactacttcgatgataactaccgtggcgctgtcgagtggaaggagctggacggcgaaatgcactatttttctccggagacgggcaaagcgtttaagggcctgaatcagatcggcgattataagtactatttcaacagcgacggcgtgatgcagaagggctttgtgtcaattaacgacaacaaacattacttcgacgactcaggcgtgatgaaggtcggatataccgagattgacggtaagcacttctacttcgcggaaaacggcgagatgcagattggtgtattcaacaccgaagacggttttaagtactttgcgcatcacaacgaagacctgggcaacgaagaaggtgaagaaatttcctatagcggtattctaaatttcaacaacaaaatttactactttgacgactcttttaccgctgtggtgggttggaaagatctagaggacggtagcaagtattacttcgacgaagataccgcagaggcgtatatcggcctgtctctgattaacgacggacaatactactttaatgatgacggcatcatgcaagtgggcttcgtcaccatcaacgataaagtattttacttttctgactctggtattattgaatcgggtgtgcagaatattgacgacaattatttttacatcgacgataatggcattgttcaaatcggcgtttttgacacttccgacggctacaaatatttcgctccggcgaacaccgtgaacgacaacatttacggccaggcggttgagtattcgggcctggtaagagtaggcgaagacgtttactactttggtgagacttacactatcgagaccggctggatctacgatatggaaaacgagtcagacaaatattactttaacccagaaaccaaaaaggcttgcaagggcatcaacctgattgatgatattaagtactacttcgacgagaaaggcattatgcgtaccggattgatttcctttgagaacaataactattatttcaacgagaacggtgaaatgcaattcggctacatcaatatcgaggataagatgttttactttggtgaggatggcgtgatgcagatcggtgttttcaacacgccggacggtttcaaatactttgcgcatcaaaacaccctagacgagaactttgagggagagtctatcaactataccggctggctggacctggacgagaagcgctactactttaccgacgagtatattgctgcaacgggaagcgtgatcatcgacggagaagagtactactttgacccggatacggctcagctagtgatttccgaataa

SEQ ID NO: 58 - protein, 2366 aa, Artificial Sequence
  VPI strain, 5mTcdB, (W102A, D288A, E515Q, W520A, C698A)
MSLVNRKQLEKMANVRFRTQEDEYVAILDALEEYHNMSENTVVEKYLKLKDINSLTDIYIDTYKKSGRNKALKKFKEYLVTEVLELKNNNLTPVEKNLHFVAIGGQINDTAINYINQWKDVNSDYNVNVFYDSNAFLINTLKKTVVESAINDTLESFRENLNDPRFDYNKFFRKRMEIIYDKQKNFINYYKAQREENPELIIDDIVKTYLSNEYSKEIDELNTYIEESLNKITQNSGNDVRNFEEFKNGESFNLYEQELVERWNLAAASDILRISALKEIGGMYLDVAMLPGIQPDLFESIEKPSSVTVDFWEMTKLEAIMKYKEYIPEYTSEHFDMLDEEVQSSFESVLASKSDKSEIFSSLGDMEASPLEVKIAFNSKGIINQGLISVKDSYCSNLIVKQIENRYKILNNSLNPAISEDNDFNTTTNTFIDSIMAEANADNGRFMMELGKYLRVGFFPDVKTTINLSGPEAYAAAYQDLLMFKEGSMNIHLIEADLRNFEISKTNISQSTEQQMASLASFDDARAKAQFEEYKRNYFEGSLGEDDNLDFSQNIVVDKEYLLEKISSLARSSERGYIHYIVQLQGDKISYEAACNLFAKTPYDSVLFQKNIEDSEIAYYYNPGDGEIQEIDKYKIPSIISDRPKIKLTFIGHGKDEFNTDIFAGFDVDSLSTEIEAAIDLAKEDISPKSIEINLLGANMFSYSINVEETYPGKLLLKVKDKISELMPSISQDSIIVSANQYEVRINSEGRRELLDHSGEWINKEESIIKDISSKEYISFNPKENKITVKSKNLPELSTLLQEIRNNSNSSDIELEEKVMLTECEINVISNIDTQIVEERIEEAKNLTSDSINYIKDEFKLIESISDALCDLKQQNELEDSHFISFEDISETDEGFSIRFINKETGESIFVETEKTIFSEYANHITEEISKIKGTIFDTVNGKLVKKVNLDTTHEVNTLNAAFFIQSLIEYNSSKESLSNLSVAMKVQVYAQLFSTGLNTITDAAKVVELVSTALDETIDLLPTLSEGLPIIATIIDGVSLGAAIKELSETSDPLLRQEIEAKIGIMAVNLTTATTAIITSSLGIASGFSILLVPLAGISAGIPSLVNNELVLRDKATKVVDYFKHVSLVETEGVFTLLDDKIMMPQDDLVISEIDFNNNSIVLGKCEIWRMEGGSGHTVTDDIDHFFSAPSITYREPHLSIYDVLEVQKEELDLSKDLMVLPNAPNRVFAWETGWTPGLRSLENDGTKLLDRIRDNYEGEFYWRYFAFIADALITTLKPRYEDTNIRINLDSNTRSFIVPIITTEYIREKLSYSFYGSGGTYALSLSQYNMGINIELSESDVWIIDVDNVVRDVTIESDKIKKGDLIEGILSTLSIEENKIILNSHEINFSGEVNGSNGFVSLTFSILEGINAIIEVDLLSKSYKLLISGELKILMLNSNHIQQKIDYIGFNSELQKNIPYSFVDSEGKENGFINGSTKEGLFVSELPDVVLISKVYMDDSKPSFGYYSNNLKDVKVITKDNVNILTGYYLKDDIKISLSLTLQDEKTIKLNSVHLDESGVAEILKFMNRKGNTNTSDSLMSFLESMNIKSIFVNFLQSNIKFILDANFIISGTTSIGQFEFICDENDNIQPYFIKFNTLETNYTLYVGNRQNMIVEPNYDLDDSGDISSTVINFSQKYLYGIDSCVNKVVISPNIYTDEINITPVYETNNTYPEVIVLDANYINEKINVNINDLSIRYVWSNDGNDFILMSTSEENKVSQVKIRFVNVFKDKTLANKLSFNFSDKQDVPVSEIILSFTPSYYEDGLIGYDLGLVSLYNEKFYINNFGMMVSGLIYINDSLYYFKPPVNNLITGFVTVGDDKYYFNPINGGAASIGETIIDDKNYYFNQSGVLQTGVFSTEDGFKYFAPANTLDENLEGEAIDFTGKLIIDENIYYFDDNYRGAVEWKELDGEMHYFSPETGKAFKGLNQIGDYKYYFNSDGVMQKGFVSINDNKHYFDDSGVMKVGYTEIDGKHFYFAENGEMQIGVFNTEDGFKYFAHHNEDLGNEEGEEISYSGILNFNNKIYYFDDSFTAVVGWKDLEDGSKYYFDEDTAEAYIGLSLINDGQYYFNDDGIMQVGFVTINDKVFYFSDSGIIESGVQNIDDNYFYIDDNGIVQIGVFDTSDGYKYFAPANTVNDNIYGQAVEYSGLVRVGEDVYYFGETYTIETGWIYDMENESDKYYFNPETKKACKGINLIDDIKYYFDEKGIMRTGLISFENNNYYFNENGEMQFGYINIEDKMFYFGEDGVMQIGVFNTPDGFKYFAHQNTLDENFEGESINYTGWLDLDEKRYYFTDEYIAATGSVIIDGEEYYFDPDTAQLVISE

SEQ ID NO: 59 - protein, 463 aa, Clostridium difficile
MKKFRKHKRISNCISILLILYLTLGGLLPNNIYAQDLQSYSEKVCNTTYKAPIERPEDFLKDKEKAKEWERKEAERIEQKLERSEKEALESYKKDSVEISKYSQTRNYFYDYQIEANSREKEYKELRNAISKNKIDKPMYVYYFESPEKFAFNKVIRTENQNEISLEKFNEFKETIQNKLFKQDGFKDISLYEPGKGDEKPTPLLMHLKLPRNTGMLPYTNTNNVSTLIEQGYSIKIDKIVRIVIDGKHYIKAEASVVSSLDFKDDVSKGDSWGKANYNDWSNKLTPNELADVNDYMRGGYTAINNYLISNGPVNNPNPELDSKITNIENALKREPIPTNLTVYRRSGPQEFGLTLTSPEYDFNKLENIDAFKSKWEGQALSYPNFISTSIGSVNMSAFAKRKIVLRITIPKGSPGAYLSAIPGYAGEYEVLLNHGSKFKINKIDSYKDGTITKLIVDATLIP

SEQ ID NO: 60 - protein, 719 aa, Artificial Sequence
  truncated TcdA from C. difficile VPI10463 strain
MSLISKEELIKLAYSIRPRENEYKTILTNLDEYNKLTTNNNENKYLQLKKLNESIDVFMNKYKTSSRNRALSNLKKDILKEVILIKNSNTSPVEKNLHFVWIGGEVSDIALEYIKQWADINAEYNIKLWYDSEAFLVNTLKKAIVESSTTEALQLLEEEIQNPQFDNMKFYKKRMEFIYDRQKRFINYYKSQINKPTVPTIDDIIKSHLVSEYNRDETVLESYRTNSLRKINSNHGIDIRANSLFTEQELLNIYSQELLNRGNLAAASDIVRLLALKNFGGVYLDVDMLPGIHSDLFKTISRPSSIGLDRWEMIKLEAIMKYKKYINNYTSENFDKLDQQLKDNFKLIIESKSEKSEIFSKLENLNVSDLEIKIAFALGSVINQALISKQGSYLTNLVIEQVKNRYQFLNQHLNPAIESDNNFTDTTKIFHDSLFNSATAENSMFLTKIAPYLQVGFMPEARSTISLSGPGAYASAYYDFINLQENTIEKTLKASDLIEFKFPENNLSQLTEQEINSLWSFDQASAKYQFEKYVRDYTGGSLSEDNGVDFNKNTALDKNYLLNNKIPSNNVEEAGSKNYVHYIIQLQGDDISYEATCNLFSKNPKNSIIIQRNMNESAKSYFLSDDGESILELNKYRIPERLKNKEKVKVTFIGHGKDEFNTSEFARLSVDSLSNEISSFLDTIKLDISPKNVEVNLLGCNMFSYDFNVEETYPGKLLL

SEQ ID NO: 61 - protein, 717 aa, Artificial Sequence
  truncated TcdB from C. difficile VPI10463 strain
MSLVNRKQLEKMANVRFRTQEDEYVAILDALEEYHNMSENTVVEKYLKLKDINSLTDIYIDTYKKSGRNKALKKFKEYLVTEVLELKNNNLTPVEKNLHFVWIGGQINDTAINYINQWKDVNSDYNVNVFYDSNAFLINTLKKTVVESAINDTLESFRENLNDPRFDYNKFFRKRMEIIYDKQKNFINYYKAQREENPELIIDDIVKTYLSNEYSKEIDELNTYIEESLNKITQNSGNDVRNFEEFKNGESFNLYEQELVERWNLAAASDILRISALKEIGGMYLDVDMLPGIQPDLFESIEKPSSVTVDFWEMTKLEAIMKYKEYIPEYTSEHFDMLDEEVQSSFESVLASKSDKSEIFSSLGDMEASPLEVKIAFNSKGIINQGLISVKDSYCSNLIVKQIENRYKILNNSLNPAISEDNDFNTTTNTFIDSIMAEANADNGRFMMELGKYLRVGFFPDVKTTINLSGPEAYAAAYQDLLMFKEGSMNIHLIEADLRNFEISKTNISQSTEQEMASLWSFDDARAKAQFEEYKRNYFEGSLGEDDNLDFSQNIVVDKEYLLEKISSLARSSERGYIHYIVQLQGDKISYEAACNLFAKTPYDSVLFQKNIEDSEIAYYYNPGDGEIQEIDKYKIPSIISDRPKIKLTFIGHGKDEFNTDIFAGFDVDSLSTEIEAAIDLAKEDISPKSIEINLLGCNMFSYSINVEETYPGKLLL

SEQ ID NO: 62 - protein, 543 aa, Clostridium Sordellii
MNLVNKAQLQKMVYVKFRIQEDEYVAILNALEEYHNMSESSVVEKYLKLKDINNLTDNYLNTYKKSGRNKALKKFKEYLTMEVLELKNNSLTPVEKNLHFIWIGGQINDTAINYINQWKDVNSDYTVKVFYDSNAFLINTLKKTIVESATNNTLESFRENLNDPEFDYNKFYRKRMEIIYDKQKHFIDYYKSQIEENPEFIIDNIIKTYLSNEYSKDLEALNKYIEESLNKITANNGNDIRNLEKFADEDLVRLYNQELVERWNLAAASDILRISMLKEDGGVYLDVDILPGIQPDLFKSINKPDSITNTSWEMIKLEAIMKYKEYIPGYTSKNFDMLDEEVQRSFESALSSKSDKSEIFLPLDDIKVSPLEVKIAFANNSVINQALISLKDSYCSDLVINQIKNRYKILNDNLNPSINEGTDFNTTMKIFSDKLASISNEDNMMFMIKITNYLKVGFAPDVRSTINLSGPGVYTGAYQDLLMFKDNSTNIHLLEPELRNFEFPKTKISQLTEQEITSLWSFNQARAKSQFEEYKKGYFEGAL

SEQ ID NO: 63 - protein, 543 aa, Clostridium difficile
MSLVNRKQLEKMANVRFRTQEDEYVAILDALEEYHNMSENTVVEKYLKLKDINSLTDIYIDTYKKSGRNKALKKFKEYLVTEVLELKNNNLTPVEKNLHFVWIGGQINDTAINYINQWKDVNSDYNVNVFYDSNAFLINTLKKTVVESAINDTLESFRENLNDPRFDYNKFFRKRMEIIYDKQKNFINYYKAQREENPELIIDDIVKTYLSNEYSKEIDELNTYIEESLNKITQNSGNDVRNFEEFKNGESFNLYEQELVERWNLAAASDILRISALKEIGGMYLDVDMLPGIQPDLFESIEKPSSVTVDFWEMTKLEAIMKYKEYIPEYTSEHFDMLDEEVQSSFESVLASKSDKSEIFSSLGDMEASPLEVKIAFNSKGIINQGLISVKDSYCSNLIVKQIENRYKILNNSLNPAISEDNDFNTTTNTFIDSIMAEANADNGRFMMELGKYLRVGFFPDVKTTINLSGPEAYAAAYQDLLMFKEGSMNIHLIEADLRNFEISKTNISQSTEQEMASLWSFDDARAKAQFEEYKRNYFEGSL

SEQ ID NO: 64 - protein, 542 aa, Clostridium difficile
MSLISKEELIKLAYSIRPRENEYKTILTNLDEYNKLTTNNNENKYLQLKKLNESIDVFMNKYKTSSRNRALSNLKKDILKEVILIKNSNTSPVEKNLHFVWIGGEVSDIALEYIKQWADINAEYNIKLWYDSEAFLVNTLKKAIVESSTTEALQLLEEEIQNPQFDNMKFYKKRMEFIYDRQKRFINYYKSQINKPTVPTIDDIIKSHLVSEYNRDETVLESYRTNSLRKINSNHGIDIRANSLFTEQELLNIYSQELLNRGNLAAASDIVRLLALKNFGGVYLDVDMLPGIHSDLFKTISRPSSIGLDRWEMIKLEAIMKYKKYINNYTSENFDKLDQQLKDNFKLIIESKSEKSEIFSKLENLNVSDLEIKIAFALGSVINQALISKQGSYLTNLVIEQVKNRYQFLNQHLNPAIESDNNFTDTTKIFHDSLFNSATAENSMFLTKIAPYLQVGFMPEARSTISLSGPGAYASAYYDFINLQENTIEKTLKASDLIEFKFPENNLSQLTEQEINSLWSFDQASAKYQFEKYVRDYTGGSL

SEQ ID NO: 65 - protein, 548 aa, Clostridium novyi
MLITREQLMKIASIPLKRKEPEYNLILDALENFNRDIEGTSVKEIYSKLSKLNELVDNYQTKYPSSGRNLALENFRDSLYSELRELIKNSRTSTIASKNLSFIWIGGPISDQSLEYYNMWKMFNKDYNIRLFYDKNSLLVNTLKTAIIQESSKVIIEQNQSNILDGTYGHNKFYSDRMKLIYRYKRELKMLYENMKQNNSVDDIIINFLSNYFKYDIGKLNNQKENNNNKMIAIGATDINTENILTNKLKSYYYQELIQTNNLAAASDILRIAILKKYGGVYCDLDFLPGVNLSLFNDISKPNGMDSNYWEAAIFEAIANEKKLMNNYPYKYMEQVPSEIKERILSFVRNHDINDLILPLGDIKISQLEILLSRLKAATGKKTFSNAFIISNNDSLTLNNLISQLENRYEILNSIIQEKFKICETYDSYINSVSELVLETTPKNLSMDGSSFYQQIIGYLSSGFKPEVNSTVFFSGPNIYSSATCDTYHFIKNTFDMLSSQNQEIFEASNNLYFSKTHDEFKSSWLLRSNIAEKEFQKLIKTYIGRTL

SEQ ID NO: 66 - protein, 542 aa, Clostridium perfringens
MGLMSKEQLIILAKNSSPKEGEYKKILELLDEYNLLNNSVEKNSIDLYLKLNELSKSIDIYLKKYKNSKRNNALYQLKSDLTKEVIEIKDTNLKPLEKNIHFVWVGGMINNISIDYINQWKDINSDYETIIWYDSEALLVNILKKAIIDSSNKEVLTKYESVLNDNSFDSNKFYRERMEVIFRKQKEFNNYYNTNDNYTKSLNDVIKVYLIEKYLKTDEELEKYINESKEVFKANGAKDIREYDILDDVELKSIYEQELLMRFNLASASDIIRVIVLNKLGGIYLDVDVLPGIKKHIFKDINKPTNISENKWQMIQLETIMKYKQYIKGYTENSFKNLPSDLQEMLQEKVVEKNLKSDIFQRLGDIFISELDTKIAFMFGKIANQVLISKKNSYSLNLIINQIKNRYNIINKCLSSAIEKGSNFNNTVDIFIQQLNEFYVNEGFFVSKVMGYLGDGYMPDMRATLNISGPGIYTAAYYDLLYFNERSLNPQILQEDLKYFEVPQALISQQTEQEINSSWTFNQVKSQIEYKKLVEKYTNKSL

SEQ ID NO: 67 - protein, 420 aa, Artificial Sequence
  4mCdtA8, CDTa with mutations C2A, S345F, E385q and E387Q
VANTTYKAPIERPEDFLKDKEKAKEWERKEAERIEQKLERSEKEALESYKKDSVEISKYSQTRNYFYDYQIEANSREKEYKELRNAISKNKIDKPMYVYYFESPEKFAFNKVIRTENQNEISLEKFNEFKETIQNKLFKQDGFKDISLYEPGKGDEKPTPLLMHLKLPRNTGMLPYTNTNNVSTLIEQGYSIKIDKIVRIVIDGKHYIKAEASVVSSLDFKDDVSKGDSWGKANYNDWSNKLTPNELADVNDYMRGGYTAINNYLISNGPVNNPNPELDSKITNIENALKREPIPTNLTVYRRSGPQEFGLTLTSPEYDFNKLENIDAFKSKWEGQALSYPNFIFTSIGSVNMSAFAKRKIVLRITIPKGSPGAYLSAIPGYAGQYQVLLNHGSKFKINKIDSYKDGTITKLIVDATLIP

SEQ ID NO: 68 - DNA, 1290 bp, Artificial Sequence
  4mCdta8 with His-tag and restriction site, Codon-optimized, CDTa with mutations C2A, S345F, E385q and E387Q
atggttgcgaacacgacctacaaggcaccgattgaacgcccggaagactttctgaaggataaggaaaaggctaaggaatgggaacgcaaagaagcggaacgtattgaacagaaactggaacgctccgaaaaggaagccctggaatcatacaaaaaggactcggtggaaatctcaaaatattcgcagacccgtaactacttctacgattaccaaatcgaagcaaatagtcgtgaaaaggaatacaaggaactgcgcaacgctatctccaagaacaagatcgataagccgatgtatgtgtattacttcgaaagcccggaaaaatttgccttcaacaaggttattcgcaccgaaaaccagaacgaaatctctctggaaaagttcaacgaattcaaggaaacgatccagaataaactgtttaagcaagatggcttcaaagacatttctctgtatgaaccgggcaaaggtgatgaaaagccgaccccgctgctgatgcatctgaaactgccgcgtaacacgggtatgctgccgtacaccaatacgaacaatgttagtaccctgattgaacaaggctattccattaaaatcgataagatcgtccgcattgtgatcgacggtaaacactacattaaggcggaagccagtgtggttagctctctggattttaaagatgacgtcagcaagggcgactcttggggtaaagcaaactataatgattggagcaacaaactgaccccgaatgaactggcggatgtcaacgactacatgcgtggcggttatacggccattaacaattatctgatctcaaacggcccggtgaacaatccgaatccggaactggattcgaaaattaccaacatcgaaaatgctctgaaacgcgaaccgatcccgaccaatctgacggtgtaccgtcgcagcggtccgcaggaatttggtctgaccctgacgtctccggaatacgatttcaacaagctggaaaacatcgacgcattcaaatcaaagtgggaaggccaagctctgtcgtacccgaactttatttttacctccatcggtagtgttaatatgtccgcattcgctaagcgtaagatcgtcctgcgcattacgatcccgaaaggcagcccgggtgcgtatctgtctgccattccgggctacgcgggtcagtatcaggttctgctgaaccatggtagcaaattcaagattaataaaattgactcatacaaggacggcaccattaccaaactgatcgtggatgctaccctgattccgctcgagcaccaccaccaccaccactga

SEQ ID NO: 69 - DNA, 1263 bp, Artificial Sequence
  4mCdta8, Codon-optimized, CDTa with mutations C2A, S345F, E385q and E387Q
atggttgcgaacacgacctacaaggcaccgattgaacgcccggaagactttctgaaggataaggaaaaggctaaggaatgggaacgcaaagaagcggaacgtattgaacagaaactggaacgctccgaaaaggaagccctggaatcatacaaaaaggactcggtggaaatctcaaaatattcgcagacccgtaactacttctacgattaccaaatcgaagcaaatagtcgtgaaaaggaatacaaggaactgcgcaacgctatctccaagaacaagatcgataagccgatgtatgtgtattacttcgaaagcccggaaaaatttgccttcaacaaggttattcgcaccgaaaaccagaacgaaatctctctggaaaagttcaacgaattcaaggaaacgatccagaataaactgtttaagcaagatggcttcaaagacatttctctgtatgaaccgggcaaaggtgatgaaaagccgaccccgctgctgatgcatctgaaactgccgcgtaacacgggtatgctgccgtacaccaatacgaacaatgttagtaccctgattgaacaaggctattccattaaaatcgataagatcgtccgcattgtgatcgacggtaaacactacattaaggcggaagccagtgtggttagctctctggattttaaagatgacgtcagcaagggcgactcttggggtaaagcaaactataatgattggagcaacaaactgaccccgaatgaactggcggatgtcaacgactacatgcgtggcggttatacggccattaacaattatctgatctcaaacggcccggtgaacaatccgaatccggaactggattcgaaaattaccaacatcgaaaatgctctgaaacgcgaaccgatcccgaccaatctgacggtgtaccgtcgcagcggtccgcaggaatttggtctgaccctgacgtctccggaatacgatttcaacaagctggaaaacatcgacgcattcaaatcaaagtgggaaggccaagctctgtcgtacccgaactttatttttacctccatcggtagtgttaatatgtccgcattcgctaagcgtaagatcgtcctgcgcattacgatcccgaaaggcagcccgggtgcgtatctgtctgccattccgggctacgcgggtcagtatcaggttctgctgaaccatggtagcaaattcaagattaataaaattgactcatacaaggacggcaccattaccaaactgatcgtggatgctaccctgattccg

SEQ ID NO: 70 - protein, 2710 aa, Artificial Sequence
  VPI 10463 strain, 5mTcdA (W101, D287, E514, W519, C700)
  VARIANT (101)..(101): Xaa is any amino acid except Trp
  VARIANT (287)..(287): Xaa is any amino acid except Asp
  VARIANT (514)..(514): Xaa is any amino acid except Glu
  VARIANT (519)..(519): Xaa is any amino acid except Trp
  VARIANT (700)..(700): Xaa is any amino acid except Cys
MSLISKEELIKLAYSIRPRENEYKTILTNLDEYNKLTTNNNENKYLQLKKLNESIDVFMNKYKTSSRNRALSNLKKDILKEVILIKNSNTSPVEKNLHFVXIGGEVSDIALEYIKQWADINAEYNIKLWYDSEAFLVNTLKKAIVESSTTEALQLLEEEIQNPQFDNMKFYKKRMEFIYDRQKRFINYYKSQINKPTVPTIDDIIKSHLVSEYNRDETVLESYRTNSLRKINSNHGIDIRANSLFTEQELLNIYSQELLNRGNLAAASDIVRLLALKNFGGVYLDVXMLPGIHSDLFKTISRPSSIGLDRWEMIKLEAIMKYKKYINNYTSENFDKLDQQLKDNFKLIIESKSEKSEIFSKLENLNVSDLEIKIAFALGSVINQALISKQGSYLTNLVIEQVKNRYQFLNQHLNPAIESDNNFTDTTKIFHDSLFNSATAENSMFLTKIAPYLQVGFMPEARSTISLSGPGAYASAYYDFINLQENTIEKTLKASDLIEFKFPENNLSQLTEQXINSLXSFDQASAKYQFEKYVRDYTGGSLSEDNGVDFNKNTALDKNYLLNNKIPSNNVEEAGSKNYVHYIIQLQGDDISYEATCNLFSKNPKNSIIIQRNMNESAKSYFLSDDGESILELNKYRIPERLKNKEKVKVTFIGHGKDEFNTSEFARLSVDSLSNEISSFLDTIKLDISPKNVEVNLLGXNMFSYDFNVEETYPGKLLLSIMDKITSTLPDVNKNSITIGANQYEVRINSEGRKELLAHSGKWINKEEAIMSDLSSKEYIFFDSIDNKLKAKSKNIPGLASISEDIKTLLLDASVSPDTKFILNNLKLNIESSIGDYIYYEKLEPVKNIIHNSIDDLIDEFNLLENVSDELYELKKLNNLDEKYLISFEDISKNNSTYSVRFINKSNGESVYVETEKEIFSKYSEHITKEISTIKNSIITDVNGNLLDNIQLDHTSQVNTLNAAFFIQSLIDYSSNKDVLNDLSTSVKVQLYAQLFSTGLNTIYDSIQLVNLISNAVNDTINVLPTITEGIPIVSTILDGINLGAAIKELLDEHDPLLKKELEAKVGVLAINMSLSIAATVASIVGIGAEVTIFLLPIAGISAGIPSLVNNELILHDKATSVVNYFNHLSESKKYGPLKTEDDKILVPIDDLVISEIDFNNNSIKLGTCNILAMEGGSGHTVTGNIDHFFSSPSISSHIPSLSIYSAIGIETENLDFSKKIMMLPNAPSRVFWWETGAVPGLRSLENDGTRLLDSIRDLYPGKFYWRFYAFFDYAITTLKPVYEDTNIKIKLDKDTRNFIMPTITTNEIRNKLSYSFDGAGGTYSLLLSSYPISTNINLSKDDLWIFNIDNEVREISIENGTIKKGKLIKDVLSKIDINKNKLIIGNQTIDFSGDIDNKDRYIFLTCELDDKISLIIEINLVAKSYSLLLSGDKNYLISNLSNTIEKINTLGLDSKNIAYNYTDESNNKYFGAISKTSQKSIIHYKKDSKNILEFYNDSTLEFNSKDFIAEDINVFMKDDINTITGKYYVDNNTDKSIDFSISLVSKNQVKVNGLYLNESVYSSYLDFVKNSDGHHNTSNFMNLFLDNISFWKLFGFENINFVIDKYFTLVGKTNLGYVEFICDNNKNIDIYFGEWKTSSSKSTIFSGNGRNVVVEPIYNPDTGEDISTSLDFSYEPLYGIDRYINKVLIAPDLYTSLININTNYYSNEYYPEIIVLNPNTFHKKVNINLDSSSFEYKWSTEGSDFILVRYLEESNKKILQKIRIKGILSNTQSFNKMSIDFKDIKKLSLGYIMSNFKSFNSENELDRDHLGFKIIDNKTYYYDEDSKLVKGLININNSLFYFDPIEFNLVTGWQTINGKKYYFDINTGAALTSYKIINGKHFYFNNDGVMQLGVFKGPDGFEYFAPANTQNNNIEGQAIVYQSKFLTLNGKKYYFDNNSKAVTGWRIINNEKYYFNPNNAIAAVGLQVIDNNKYYFNPDTAIISKGWQTVNGSRYYFDTDTAIAFNGYKTIDGKHFYFDSDCVVKIGVFSTSNGFEYFAPANTYNNNIEGQAIVYQSKFLTLNGKKYYFDNNSKAVTGLQTIDSKKYYFNTNTAEAATGWQTIDGKKYYFNTNTAEAATGWQTIDGKKYYFNTNTAIASTGYTIINGKHFYFNTDGIMQIGVFKGPNGFEYFAPANTDANNIEGQAILYQNEFLTLNGKKYYFGSDSKAVTGWRIINNKKYYFNPNNAIAAIHLCTINNDKYYFSYDGILQNGYITIERNNFYFDANNESKMVTGVFKGPNGFEYFAPANTHNNNIEGQAIVYQNKFLTLNGKKYYFDNDSKAVTGWQTIDGKKYYFNLNTAEAATGWQTIDGKKYYFNLNTAEAATGWQTIDGKKYYFNTNTFIASTGYTSINGKHFYFNTDGIMQIGVFKGPNGFEYFAPANTDANNIEGQAILYQNKFLTLNGKKYYFGSDSKAVTGLRTIDGKKYYFNTNTAVAVTGWQTINGKKYYFNTNTSIASTGYTIISGKHFYFNTDGIMQIGVFKGPDGFEYFAPANTDANNIEGQAIRYQNRFLYLHDNIYYFGNNSKAATGWVTIDGNRYYFEPNTAMGANGYKTIDNKNFYFRNGLPQIGVFKGSNGFEYFAPANTDANNIEGQAIRYQNRFLHLLGKIYYFGNNSKAVTGWQTINGKVYYFMPDTAMAAAGGLFEIDGVIYFFGVDGVKAPGIYG

SEQ ID NO: 71 - protein, 2366 aa, Artificial Sequence
  Nap strain, 5mTcdB, (W102, D288, E515, W520, C698)
  VARIANT (102)..(102): Xaa is any amino acid except Trp
  VARIANT (288)..(288): Xaa is any amino acid except Asp
  VARIANT (515)..(515): Xaa is any amino acid except Glu
  VARIANT (520)..(520): Xaa is any amino acid except Trp
  VARIANT (698)..(698): Xaa is any amino acid except Cys
MSLVNRKQLEKMANVRFRVQEDEYVAILDALEEYHNMSENTVVEKYLKLKDINSLTDIYIDTYKKSGRNKALKKFKEYLVTEVLELKNNNLTPVEKNLHFVXIGGQINDTAINYINQWKDVNSDYNVNVFYDSNAFLINTLKKTIVESATNDTLESFRENLNDPRFDYNKFYRKRMEIIYDKQKNFINYYKTQREENPDLIIDDIVKIYLSNEYSKDIDELNSYIEESLNKVTENSGNDVRNFEEFKGGESFKLYEQELVERWNLAAASDILRISALKEVGGVYLDVXMLPGIQPDLFESIEKPSSVTVDFWEMVKLEAIMKYKEYIPGYTSEHFDMLDEEVQSSFESVLASKSDKSEIFSSLGDMEASPLEVKIAFNSKGIINQGLISVKDSYCSNLIVKQIENRYKILNNSLNPAISEDNDFNTTTNAFIDSIMAEANADNGRFMMELGKYLRVGFFPDVKTTINLSGPEAYAAAYQDLLMFKEGSMNIHLIEADLRNFEISKTNISQSTEQXMASLXSFDDARAKAQFEEYKKNYFEGSLGEDDNLDFSQNTVVDKEYLLEKISSLARSSERGYIHYIVQLQGDKISYEAACNLFAKTPYDSVLFQKNIEDSEIAYYYNPGDGEIQEIDKYKIPSIISDRPKIKLTFIGHGKDEFNTDIFAGLDVDSLSTEIETAIDLAKEDISPKSIEINLLGXNMFSYSVNVEETYPGKLLLRVKDKVSELMPSISQDSIIVSANQYEVRINSEGRRELLDHSGEWINKEESIIKDISSKEYISFNPKENKIIVKSKNLPELSTLLQEIRNNSNSSDIELEEKVMLAECEINVISNIDTQVVEGRIEEAKSLTSDSINYIKNEFKLIESISDALYDLKQQNELEESHFISFEDILETDEGFSIRFIDKETGESIFVETEKAIFSEYANHITEEISKIKGTIFDTVNGKLVKKVNLDATHEVNTLNAAFFIQSLIEYNSSKESLSNLSVAMKVQVYAQLFSTGLNTITDAAKVVELVSTALDETIDLLPTLSEGLPVIATIIDGVSLGAAIKELSETSDPLLRQEIEAKIGIMAVNLTAATTAIITSSLGIASGFSILLVPLAGISAGIPSLVNNELILRDKATKVVDYFSHISLAESEGAFTSLDDKIMMPQDDLVISEIDFNNNSITLGKCEIWRMEGGSGHTVTDDIDHFFSAPSITYREPHLSIYDVLEVQKEELDLSKDLMVLPNAPNRVFAWETGWTPGLRSLENDGTKLLDRIRDNYEGEFYWRYFAFIADALITTLKPRYEDTNIRINLDSNTRSFIVPVITTEYIREKLSYSFYGSGGTYALSLSQYNMNINIELNENDTWVIDVDNVVRDVTIESDKIKKGDLIENILSKLSIEDNKIILDNHEINFSGTLNGGNGFVSLTFSILEGINAVIEVDLLSKSYKVLISGELKTLMANSNSVQQKIDYIGLNSELQKNIPYSFMDDKGKENGFINCSTKEGLFVSELSDVVLISKVYMDNSKPLFGYCSNDLKDVKVITKDDVIILTGYYLKDDIKISLSFTIQDENTIKLNGVYLDENGVAEILKFMNKKGSTNTSDSLMSFLESMNIKSIFINSLQSNTKLILDTNFIISGTTSIGQFEFICDKDNNIQPYFIKFNTLETKYTLYVGNRQNMIVEPNYDLDDSGDISSTVINFSQKYLYGIDSCVNKVIISPNIYTDEINITPIYEANNTYPEVIVLDTNYISEKINININDLSIRYVWSNDGSDFILMSTDEENKVSQVKIRFTNVFKGNTISDKISFNFSDKQDVSINKVISTFTPSYYVEGLLNYDLGLISLYNEKFYINNFGMMVSGLVYINDSLYYFKPPIKNLITGFTTIGDDKYYFNPDNGGAASVGETIIDGKNYYFSQNGVLQTGVFSTEDGFKYFAPADTLDENLEGEAIDFTGKLTIDENVYYFGDNYRAAIEWQTLDDEVYYFSTDTGRAFKGLNQIGDDKFYFNSDGIMQKGFVNINDKTFYFDDSGVMKSGYTEIDGKYFYFAENGEMQIGVFNTADGFKYFAHHDEDLGNEEGEALSYSGILNFNNKIYYFDDSFTAVVGWKDLEDGSKYYFDEDTAEAYIGISIINDGKYYFNDSGIMQIGFVTINNEVFYFSDSGIVESGMQNIDDNYFYIDENGLVQIGVFDTSDGYKYFAPANTVNDNIYGQAVEYSGLVRVGEDVYYFGETYTIETGWIYDMENESDKYYFDPETKKAYKGINVIDDIKYYFDENGIMRTGLITFEDNHYYFNEDGIMQYGYLNIEDKTFYFSEDGIMQIGVFNTPDGFKYFAHQNTLDENFEGESINYTGWLDLDEKRYYFTDEYIAATGSVIIDGEEYYFDPDTAQLVISE

SEQ ID NO: 72 - protein, 419 aa, Artificial Sequence
  4mCdtA8, CDTa with mutations C2, S345, E385 and E387
  VARIANT (2)..(2): Xaa is any amino acid except Cys
  VARIANT (345)..(345): Xaa is any amino acid except Ser
  VARIANT (385)..(385): Xaa is any amino acid except Glu
  VARIANT (387)..(387): Xaa is any amino acid except Glu
VXNTTYKAPIERPEDFLKDKEKAKEWERKEAERIEQKLERSEKEALESYKKDSVEISKYSQTRNYFYDYQIEANSREKEYKELRNAISKNKIDKPMYVYYFESPEKFAFNKVIRTENQNEISLEKFNEFKETIQNKLFKQDGFKDISLYEPGKGDEKPTPLLMHLKLPRNTGMLPYTNTNNVSTLIEQGYSIKIDKIVRIVIDGKHYIKAEASVVSSLDFKDDVSKGDSWGKANYNDWSNKLTPNELADVNDYMRGGYTAINNYLISNGPVNNPNPELDSKITNIENALKREPIPTNLTVYRRSGPQEFGLTLTSPEYDFNKLENIDAFKSKWEGQALSYPNFIXTSIGSVNMSAFAKRKIVLRITIPKGSPGAYLSAIPGYAGXYXVLLNHGSKFKINKIDSYKDGTITKLIVDATLI

SEQ ID NO: 73 - protein, 463 aa, Clostridium difficile
MKKFRKYKSISNCISISLILYLTLGSLLPNNIYAQDLQSYSEKVYNTTYKAPIERPEDFLKDKEKAKEWERKEAERIEQKLERSEKEALESYKKDSVEINKYSQTRNYFYDYQIEANSREKEYRELRNAISKNKIDKPMYVYYFESPEKFAFNKVIRTENQNEISLEKFNEFKETIQDKLFKQDGFKDISLYEPGKGDEKPTPLLMHLKLPRNTGMLPYTNTNNISTLIEQGYSIKIDKIVRIVIDGKHYIKAEASVVNSLDFKDDVSKGDSWGKANYSDWSNKLTPNELADVNDYMRGGYTAINNYLISNGPVNNPNSELDSKITNIENALKREPIPTNLTVYRRSGPQEFGLTLTSPEYDFNKPENIDAFKSKWEGQTLSYPNFISTSIGSVNMSAFAKRKIVLRITIPKGSPGAYLSAIPGYAGEYEVLLNHGSKFKISKIDSYKDGAITKLIVDATLIP

SEQ ID NO: 74 - protein, 463 aa, Clostridium difficile
MKKFRKHKSISNCISILLILYLTLGSLLPNNIYAQDLQSYSEKVCNTTYKAPIERPEDFLKDKERAKEWERKEAERIEQKLERSEKEALESYKKDSVEINKYSQTRNYFYDYQIEANSREKEYRELRNAISKNKIDKPMYVYYFESPEKFAFNKVIRTENQNEISLEKFNEFKETIQNKLFKQDGFKEISLYEPGKGDEEPTPLLMHLKLPRNTGMLPYTNTNNVSTLIEQGYSIKIDKIVRIVIDGKHYIKAEASVVSSLDFKDDVSKGDSWGKANYNDWSNKLTPNELADVNDYMRGGYTAINNYLISNGPVNNPNPELDSKITNIENALKREPIPTNLTVYRRSGPQEFGLTLTSPEYDFNKPENIDAFKSKWEGQTLSYPNFISTSIGSVNMSAFAKRKIVLRITIPKGSPGAYLSAIPGYAGEYEVLLNHGSKFKISKIDSYKDGAITKLIVDATLIP

SEQ ID NO: 75 - protein, 463 aa, Clostridium difficile
MKKFRKHKRISNCISILLILYLTLGGLLPNNIYAQDLQSYSEKVCNTTYKAPIERPEDFLKDKEKAKEWERKEAERIEQKLERSEKEALESYKKDSVEISKYSQTRNYFYDYQIEANSREKEYKELRNAISKNKIDKPMYVYYFESPEKFAFNKVIRTENQNEISLEKFNEFKETIQNKLFKQDGFKDISLYEPGKGDEKPTPLLMHLKLPRNTGMLPYTNTNNVSTLIEQGYSIKIDKIVRIVIDGKHYIKAEASVVSSLDFKDDVSKGDSWGKANYNDWSNKLTPNELADVNDYMRGGYTAINNYLISNGPVVNPNPELDSKITNIENALKREPIPTNLTVYRRSGPQEFGLTLTSPEYDFNKLENIDAFKSKWEGQALSYPNFISTSIGSVNMSAFAKRKIVLRITIPKGSPGAYLSAIPGYAGEYEVLLNHGSKFKINKIDSYKDGTITKLIVDATLIP

SEQ ID NO: 76 - protein, 463 aa, Clostridium difficile
MKKFRKHKRISNCISILLILYLTLGGLLPNNIYAQDLQSYSEKVCNTTYKAPIERPEDFLKDKEKAKEWERKEAERIEQKLERSEKEALESYKKDSVEISKYSQTRNYFYDYQIEANSREKEYKELRNAISKNKIDKPMYVYYFESPEKFAFNKVIRTENQNEISLEKFNEFKETIQNKLFKQDGFKDISLYEPGKGDEKPTPLLMHLKLPRNTGMLPYTNTNNVSTLIEQGYSIKIDKIVRIVIDGKHYIKAEASVVNSLDFKDDVSKGDSWGKANYNDWSNKLTPNELADVNDYMRGGYTAINNYLISNGPVNNPNPELDSKITNIENALKREPIPTNLTVYRRSGPQEFGLTLTSPEYDFNKLENIDAFKSKWEGQALSYPNFISTSIGSVNMSAFAKRKIVLRITIPKGSPGAYLSAIPGYAGEYEVLLNHGSKFKINKIDSYKDGTITKLIVDATLIP

SEQ ID NO: 77 - protein, 463 aa, Clostridium difficile
MKKFRKHKRISNCIFILLILYLTLGGLLPNNIYAQDLQSYSEKVCNTTYKAPIERPEDFLKDKEKAKEWERKEAERIEQKLERSEKEALESYKKDSVEISKYSQTRNYFYDYQIEANSREKEYKELRNAISKNKIDKPMYVYYFESPEKFAFNKVIRTENQNEISLEKFNEFKETIQNKLFKQDGFKDISLYEPGKGDEKPTPLLMHLKLPRNTGMLPYTNTNNVSTLIEQGYSIKIDKIVRIVIDGKHYIKAEASVVSSLDFKDDVSKGDSWGKANYNDWSNKLTPNELADVNDYMRGGYTAINNYLISNGPVNNPNPELDSKITNIENALKREPIPTNLTVYRRSGPQEFGLTLTSPEYDFNKLENIDAFKSKWEGQALSYPNFISTSIGSVNMSAFAKRKIVLRITIPKGSPGAYLSAIPGYAGEYEVLLNHGSKFKINKIDSYKDGTITKLIVDATLIP

SEQ ID NO: 78 - protein, 876 aa, Clostridium difficile
MKIQMRNKKVLSFLTLTAIVSQALAYPVYAQTSTSSHSDNKKEIINEDILTNNGLMGYYFTDEHFKDLKLMAPIKDGNLKFEEKKVDKLLNKDKSNVKSIRWTGRIIPSKDGEYTLSTDRDDILMQVNNESTISNTLKVNMKKGKEYKFRIELQDKNLGSIDNLSSPNLYWELDGIKKIIPAENLFLRDYSNIEKNDPFIPNNNFFDPRLMSDWEDEDLDTDNDNIPDSYERNGYTIKDLIAVKWEDSFAEQGYKKYVSNYLESNTAGDPYTDYEKASGSFDKAIKTEARDPLVAAYPIVGVGMEKLIISTNEHASTDQGKTVSRATTNSKTESNTAGVSVNVGYQNGFTANVTTNYSHTTDNSTAVQDSNGESWNTGLSINKGESAYINANVRYYNTGTAPMYKVTPTTNLVLDGDTLSTIKAQENQIGNNLSPGDTYPKKGLSPLALNTMDQFSSRLIPINYDQLKKLDAGKQIKLETTQVSGNFGTKNSSGQIVTEGNSWSDYISQIDSISASIILDTENESYERRVTAKNLQNPEDKTPELTIGEAIEKAFGATKKDGLLYFNDIPIDESCVELIFDDNIGNKIKDSLKTLSDKQICNVKLERGMNILIKTPTYFTNFDDYNNYPSTWSNVNTTNQDGLQGSANKLNGETKIKIPMSKLKPYKRYVFSGYSKDPLTSNSIIVKIKAKEEKTDYLVPEQGYTKFSYEFETTEKDSSNIEITLIGSGTTYLDNLSITELNSTPEILNEPEVKIPTDQEIIDAHKIYSADLNFNPSTGNAYINGMYFTPTQTNKEALDYIQKYRVEATLQYSGFKDIGTKDKEMRNYLGDPNQPKTNYVNLRSYFTGGENIMTYKKLRIYAITPDDRELLVLSVD

SEQ ID NO: 79 - protein, 876 aa, Clostridium difficile
MKVQMRNKKVLSFLTLTAIVSQALAYPVYAQTSTSSHSDNKKEIINEDILTNNGLMGYYFTDEHFKDLKLMAPIKDGNLKFEEKKVDKLLNKDKSNVKSIRWTGRIIPSKDGEYTLSTDRDDILMQVNNESTISNTLKVNMKKGKEYKFRIELQDKNLGSIDNLSSPNLYWELDGIKKIIPAENLFLRDYSNIEKNDPFIPNNNFFDPRLMSDWEDEDLDTDNDNIPDSYERNGYTIKDLIAVKWEDSFAEQGYKKYVSNYLESNTAGDPYTDYEKASGSFDKAIKTEARDPLVAAYPIVGVGMEKLIISTNEHASTDQGKTVSRATTNSKTESNTAGVSVNVGYQNGFTANVTTNYSHTTDNSTAVQDSNGESWNTGLSINKGESAYINANVRYYNTGTAPMYKVTPTTNLVLDGDTLSTIKAQENQIGNNLSPGDTYPKKGLSPLALNTMDQFSSRLIPINYDQLKKLDAGKQIKLETTQVSGNFGTKNSSGQIVTEGNSWSDYISQIDSISASIILDTENESYERRVTAKNLQNPEDKTPELTIGEAIEKAFGATKKDGLLYFNDIPIDESCVELIFDDNTANKIKDSLKTLSDKKIYNVKLERGMNILIKTPTYFTNFDDYNNYPSTWSNVNTTNQDGLQGSANKLNGETKIKIPMSKLKPYKRYVFSGYSKDPLTSNSIIVKIKAKEEKTDYLVPEQGYTKFSYEFETTEKDSSNIEITLIGSGTTYLDNLSITELNSTPEILNEPEVKIPTDQEIIDAHKIYSADLNFNPSTGNAYINGMYFTPTQTNKEALDYIQKYRVEATLQYSGFKDIGTKDKEMRNYLGDPNQPKTNYVNLRSYFTGGENIMTYKKLRIYAITPDDRELLVLSVD

SEQ ID NO: 80 - protein, 876 aa, Clostridium difficile
MKVQMRNKKVLSFLTFTAIVSQALVYPVYAQTSTSNHSNKKKEIINEDILPNNGLMGYYFTDEHFKDLKLMAPIKDGNLKFEEKKVDKLLDKDKSDVKSIRWTGRIIPSKDGEYTLSTDRDDVLMQVNTESTISNKLKVNMKKGKEYKVRIELQDKNLGSIDNLSSPNLYWELDGIKKIIPAENLFLRDYSNIEKNDPFIPNNNFFDPRLMSDWEDEDLDTDNDNIPDSYERNGYTIKDLIAVKWEDSFAEQGYKKYVSNYLESNTAGDPYTDYEKASGSFDKAIKTEARDPLVAAYPIVGVGMEKLIISTNEHASTDQGKTVSRATTNSKTESNTAGVSVNVGYQNGFTANVTTNYSHTTDNSTAVQDSNGESWNTGLSINKGESAYINANVRYYNTGTAPMYKVTPTTNLVLDGDTLSTIKAQENQIGNNLSPGDTYPKKGLSPLALNTMDQFSSRLIPINYDQLKKLDAGKQIKLETTQVSGNFGTKNSSGQIVTEGNSWSDYISQIDSISASIILDTENESYERRVTAKNFQDPEDKTPELTIGEAIEKAFGATKKDGLLYFNDIPIDESCVELIFDDNTANKIKDSLKTLSDKQIYNVKLERGMNILIKTPTYFINFDDYNNYPSIWSNVNTTNQDGLQGSANKLNGETKIKIPMSELKPYKRYVFSGYSKDPLTSNSIIVKIKAKEEKTDFLVPEQEYTKFSYEFETTEKDSSNIEITLIGSGTTYLDNLSITELNSTPEILNEPEVKIPTDQEIIDAHKIYSADLNFNPSTGNAYINGMYFTPTQTNKEALDYIQKYRVEATLQYSGFKDIGTKDKEMRNYLGDPNQPKTNYVNLRSYFTGGENIMTYKKLRIYAITPDDRELLVLSVD

SEQ ID NO: 81 - protein, 876 aa, Clostridium difficile
MKIQMRNKKVLSFLTLTAIVSQALVYPVYAQTSTSNHSNKKKEIVNEDILPNNGLMGYYFTDEHFKDLKLMAPIKDGNLKFEEKKVDKLLDKDKSDVKSIRWTGRIIPSKDGEYTLSTDRDDVLMQVNTESTISNTLKVNMKKGKEYKVRIELQDKNLGSIDNLSSPNLYWELDGMKKIIPEENLFLRDYSNIEKDDPFIPNNNFFDPKLMSDWEDEDLDTDNDNIPDSYERNGYTIKDLIAVKWEDSFAEQGYKKYVSNYLESNTAGDPYTDYEKASGSFDKAIKTEARDPLVAAYPIVGVGMEKLIISTNEHASTDQGKTVSRATTNSKTESNTAGVSVNVGYQNGFTANVTTNYSHTTDNSTAVQDSNGESWNTGLSINKGESAYINANVRYYNTGTAPMYKVTPTTNLVLDGDTLSTIKAQENQIGNNLSPGDTYPKKGLSPLALNTMDQFSSRLIPINYDQLKKLDAGKQIKLETTQVSGNFGTKNSSGQIVTEGNSWSDYISQIDSISASIILDTENESYERRVTAKNLQDPEDKTPELTIGEAIEKAFGATKKDGLLYFNDIPIDESCVELIFDDNTANKIKDSLKTLSDKKIYNVKLERGMNILIKTPTYFTNFDDYNNYPSTWSNVNTTNKDGLQGSANKLNGETKIKIPMSELKPYKRYVFSGYSKDPLTSNSIIVKIKAKEEKTDYLVPEQGYTKFSYEFETTEKDSSNIEITLIGSGTTYLDNLSITELNSTPEILDEPEVKIPTDQEIIDAHKIYFADLNFNPSTGNTYINGMYFAPTQTNKEALDYIQKYRVEATLQYSGFKDIGTKDKEMRNYLGDPNQPKTNYVNLRSYFTGGENIMTYKKLRIYAITPYDRELLVLSVD

SEQ ID NO: 82 - protein, 876 aa, Clostridium difficile
MKIQMRNKKVLSFLTLTAIVSQALVYPVYAQTSTSNHSNKKKEIVNEDILPNNGLMGYYFTDEHFKDLKLMAPIKDGNLKFEEKKVDKLLDKDKSDVKSIRWTGRIIPSKDGEYTLSTDRDDVLMQVNTESTISNTLKVNMKKGKEYKVRIELQDKNLGSIDNLSSPNLYWELDGMKKIIPEENLFLRDYSTIEKDDPFIPNNNFFDPKLMSDWEDEDLDTDNDNIPDSYERNGYTIKDLIAVKWEDSFAEQGYKKYVSNYLESNTAGDPYTDYEKASGSFDKAIKTEARDPLVAAYPIVGVGMEKLIISTNEHASTDQGKTVSRATTNSKTESNTAGVSVNVGYQNGFTANVTTNYSHTTDNSTAVQDSNGESWNTGLSINKGESAYINANVRYYNTGTAPMYKVTPTTNLVLDGDTLSTIKAQENQIGNNLSPGDTYPKKGLSPLALNTMDQFSSRLIPINYDQLKKLDAGKQIKLETTQVSGNFGTKNSSGQIVTEGNSWSDYISQIDSISASIILDTENESYERRVTAKNLQDPEDKTPELTIGEAIEKAFGATKKDGLLYFNDIPIDESCVELIFDDNTANKIKDSLKTLSDKKIYNVKLERGMNILIKTPTYFTNFDDYNNYPSTWSNVNTTNKDGLQGSANKLNGETKIKIPMSELKPYKRYVFSGYSKDPLTSNSIIVKIKAKEEKTDYLVPEQGYTKFSYEFETTEKDSSNIEITLIGSGTTYLDNLSITELNSTPEILDEPEVKIPTDQEIIDAHKIYFADLNFNPSTGNTYINGMYFAPTQTNKEALDYIQKYRVEATLQYSGFKDIGTKDKEMRNYLGDPNQPKTNYVNLRSYFTGGENIMTYKKLRIYAITPDDRELLVLSVD

SEQ ID NO: 83 - protein, 876 aa, Clostridium difficile
MKIQMRNKKVLSFLTLTAIVSQALVYPVYAQTSTSNHSNKKKEIVNEDILPNNGLMGYYFTDEHFKDLKLMAPIKDGNLKFEEKKVDKLLDKDKSDVKSIRWTGRIIPSKDGEYTLSTDRDDVLMQVNTESTISNTLKVNMKKGKEYKVRIELQDKNLGSIDNLSSPNLYWELDGMKKIIPEENLFLRDYSNIEKDDPFIPNNNFFDPKLMSDWEDEDLDTDNDNIPDSYERNGYTIKDLIAVKWEDSFAEQGYKKYVSNYLESNTAGDPYTDYEKASGSFDKAIKTEARDPLVAAYPIVGVGMEKLIISTNEHASTDQGKTVSRATTNSKTESNTAGVSVNVGYQNGFTANVTTNYSHTTDNSTAVQDSNGESWNTGLSINKGESAYINANVRYYNTGTAPMYKVTPTTNLVLDGDTLSTIKAQENQIGNNLSPGDTYPKKGLSPLALNTMDQFSSRLIPINYDQLKKLDAGKQIKLETTQVSGNFGTKNSSGQIVTEGNSWSDYISQIDSISASIILDTENESYERRVTAKNLQDPEDKTPELTIGEAIEKAFGATKKDGLLYFNDIPIDESCVELIFDDNTANKIKDSLKTLSDKKIYNVKLERGMNILIKTPTYFTNFDDYNNYPSTWSNVNTTNKDGLQGSANKLNGETKIKIPMSELKPYKRYVFSGYSKDPLTSNSIIVKIKAKEEKTDYLVPEQGYTKFSYEFETTEKDSSNIEITLIGSGTTYLDNLSITELNSTPEILDEPEVKIPTDQEIIDAHKIYFADLNFNPSTGNTYINGMYFAPTQTNKEALDYIQKYRVEATLQYSGFKDIGTKDKEMRNYLGDPNQPKTNYVNLRSYFTGGENIMTYKKLRIYAITPDDRELLVLSVD

SEQ ID NO: 84 - protein, 876 aa, Clostridium difficile
MKIQMRNKKVLSFLTLTAIVSQALVYPVYAQTSTSNHSNKKKEIVNEDILPNNGLMGYYFSDEHFKDLKLMAPIKDGNLKFEEKKVDKLLDKDKSDVKSIRWTGRIIPSKDGEYTLSTDRDDVLMQVNTESTISNTLKVNMKKGKEYKVRIELQDKNLGSIDNLSSPNLYWELDGMKKIIPEENLFLRDYSNIEKDDPFIPNNNFFDPKLMSDWEDEDLDTDNDNIPDSYERNGYTIKDLIAVKWEDSFAEQGYKKYVSNYLESNTAGDPYTDYEKASGSFDKAIKTEARDPLVAAYPIVGVGMEKLIISTNEHASTDQGKTVSRATTNSKTESNTAGVSVNVGYQNGFTANVTTNYSHTTDNSTAVQDSNGESWNTGLSINKGESAYINANVRYYNTGTAPMYKVTPTTNLVLDGDTLSTIKAQENQIGNNLSPGDTYPKKGLSPLALNTMDQFSSRLIPINYDQLKKLDAGKQIKLETTQVSGNFGTKNSSGQIVTEGNSWSDYISQIDSISASIILDTENESYERRVTAKNLQDPEDKTPELTIGEAIEKAFGATKKDGLLYFNDIPIDESCVELIFDDNTANKIKDSLKTLSDKKIYNVKLERGMNILIKTPTYFTNFDDYNNYPSTWSNVNTTNQDGLQGSANKLNGETKIKIPMSELKPYKRYVFSGYSKDPLTSNSIIVKIKAKEEKTDYLVPEQGYTKFSYEFETTEKDSSNIEITLIGSGTTYLDNLSITELNSTPEILDEPEVKIPTDQEIMDAHKIYFADLNFNPSTGNTYINGMYFAPTQTNKEALDYIQKYRVEATLQYSGFKDIGTKDKEMRNYLGDPNQPKTNYVNLRSYFTGGENIMTYKKLRIYAITPDDRELLVLSVD

SEQ ID NO: 85 - protein, 876 aa, Clostridium difficile
MKIQMRNKKVLSFLTLTAIVSQALVYPVYAQTSTSNHSNKKKEIVNEDILPNNGLMGYYFTDEHFKDLKLMAPIKDGNLKFEEKKVDKLLDKDKSDVKSIRWTGRIIPSKDGEYTLSTDRDDVLMQVNTESTISNTLKVNMKKGKEYKVRIELQDKNLGSIDNLSSPNLYWELDGMKKIIPEENLFLRDYSNIEKDDPFIPNNNFFDPKLMSDWEDEDLDTDNDNIPDSYERNGYTIKDLIAVKWEDSFAEQGYKKYVSNYLESNTAGDPYTDYEKASGSFDKAIKTEARDPLVAAYPIVGVGMEKLIISTNEHASTDQGKTVSRATTNSKTESNTAGVSVNVGYQNGFTANVTTNYSHTTDNSTAVQDSNGESWNTGLSINKGESAYINANVRYYNTGTAPMYKVTPTTNLVLDGDTLSTIKAQENQIGNNLSPGDTYPKKGLSPLALNTMDQFSSRLIPINYDQLKKLDAGKQIKLETTQVSGNFGTKNSSGQIVTEGNSWSDYISQIDSISASIILDTENESYERRVTAKNLQDPEDKTPELTIGEAIEKAFGATKKDGLLYFNDIPIDESCVELIFDDNTANKIKDSLKTLSDKKIYNVKLERGMNILIKTPTYFTNFDDYNNYPSTWSNVNTTNQDGLQGSANKLNGETKIKIPMSELKPYKRYVFSGYSKDPLTSNSIIVKIKAKEEKTDYLVPEQGYTKFSYEFETTEKDSSNIEITLIGSGTTYLDNLSITELSSTPEILDEPEVKIPTDQEIMDAHKIYFADLNFNPSTGNTYINGMYFAPTQTNKEALDYIQKYRVEATLQYSGFKDIGTKDKEMRNYLGDPNQPKTNYVNLRSYFTGGENIMTYKKLRIYAITPDDRELLVLSVD

SEQ ID NO: 86 - protein, 2366 aa, Clostridium difficile
MSLVNRKQLEKMANVRFRTQEDEYVAILDALEEYHNMSENTVVEKYLKLKDINSLTDIYIDTYKKSGRNKALKKFKEYLVTEVLELKNNNLTPVEKNLHFVWIGGQINDTAINYINQWKDVNSDYNVNVFYDSNAFLINTLKKTVVESAINDTLESFRENLNDPRFDYNKFFRKRMEIIYDKQKNFINYYKAQREENPELIIDDIVKTYLSNEYSKEIDELNTYIEESLNKITQNSGNDVRNFEEFKNGESFNLYEQELVERWNLAAASDILRISALKEIGGMYLDVDMLPGIQPDLFESIEKPSSVTVDFWEMTKLEAIMKYKEYIPEYTSEHFDMLDEEVQSSFESVLASKSDKSEIFSSLGDMEASPLEVKIAFNSKGIINQGLISVKDSYCSNLIVKQIENRYKILNNSLNPAISEDNDFNTTTNTFIDSIMAEANADNGRFMMELGKYLRVGFFPDVKTTINLSGPEAYAAAYQDLLMFKEGSMNIHLIEADLRNFEISKTNISQSTEQEMASLWSFDDARAKAQFEEYKRNYFEGSLGEDDNLDFSQNIVVDKEYLLEKISSLARSSERGYIHYIVQLQGDKISYEAACNLFAKTPYDSVLFQKNIEDSEIAYYYNPGDGEIQEIDKYKIPSIISDRPKIKLTFIGHGKDEFNTDIFAGFDVDSLSTEIEAAIDLAKEDISPKSIEINLLGCNMFSYSINVEETYPGKLLLKVKDKISELMPSISQDSIIVSANQYEVRINSEGRRELLDHSGEWINKEESIIKDISSKEYISFNPKENKITVKSKNLPELSTLLQEIRNNSNSSDIELEEKVMLTECEINVISNIDTQIVEERIEEAKNLTSDSINYIKDEFKLIESISDALCDLKQQNELEDSHFISFEDISETDEGFSIRFINKETGESIFVETEKTIFSEYANHITEEISKIKGTIFDTVNGKLVKKVNLDTTHEVNTLNAAFFIQSLIEYNSSKESLSNLSVAMKVQVYAQLFSTGLNTITDAAKVVELVSTALDETIDLLPTLSEGLPIIATIIDGVSLGAAIKELSETSDPLLRQEIEAKIGIMAVNLTTATTAIITSSLGVASGFSILLVPLAGISAGIPSLVNNELVLRDKATKVVDYFKHVSLVETEGVFTLLDDKIMMPQDDLVISEIDFNNNSIVLGKCEIWRMEGGSGHTVTDDIDHFFSAPSITYREPHLSIYDVLEVQKEELDLSKDLMVLPNAPNRVFAWETGWTPGLRSLENDGTKLLDRIRDNYEGEFYWRYFAFIADALITTLKPRYEDTNIRINLDSNTRSFIVPIITTEYIREKLSYSFYGSGGTYALSLSQYNMGINIELSESDVWIIDVDNVVRDVTIESDKIKKGDLIEGILSTLSIEENKIILNSHEINFSGEVNGSNGFVSLTFSILEGINAIIEVDLLSKSYKLLISGELKILMLNSNHIQQKIDYIGFNSELQKNIPYSFVDSEGKENGFINGSTKEGLFVSELPDVVLISKVYMDDSKPSFGYYSNNLKDVKVITKDNVNILTGYYLKDDIKISLSLTLQDEKTIKLNSVHLDESGVAEILKFMNRKGNTNTSDSLMSFLESMNIKSIFVNFLQSNIKFILDANFIISGTTSIGQFEFICDENDNIQPYFIKFNTLETNYTLYVGNRQNMIVEPNYDLDDSGDISSTVINFSQKYLYGIDSCVNKVVISPNIYTDEINITPVYETNNTYPEVIVLDANYINEKINVNINDLSIRYVWSNDGNDFILMSTSEENKVSQVKIRFVNVFKDKTLANKLSFNFSDKQDVPVSEIILSFTPSYYEDGLIGYDLGLVSLYNEKFYINNFGMMVSGLIYINDSLYYFKPPVNNLITGFVTVGDDKYYFNPINGGAASIGETIIDDKNYYFNQSGVLQTGVFSTEDGFKYFAPANTLDENLEGEAIDFTGKLIIDENIYYFDDNYRGAVEWKELDGEMHYFSPETGKAFKGLNQIGDYKYYFNSDGVMQKGFVSINDNKHYFDDSGVMKVGYTEIDGKHFYFAENGEMQIGVFNTEDGFKYFAHHNEDLGNEEGEEISYSGILNFNNKIYYFDDSFTAVVGWKDLEDGSKYYFDEDTAEAYIGLSLINDGQYYFNDDGIMQVGFVTINDKVFYFSDSGIIESGVQNIDDNYFYIDDNGIVQIGVFDTSDGYKYFAPANTVNDNIYGQAVEYSGLVRVGEDVYYFGETYTIETGWIYDMENESDKYYFNPETKKACKGINLIDDIKYYFDEKGIMRTGLISFENNNYYFNENGEMQFGYINIEDKMFYFGEDGVMQIGVFNTPDGFKYFAHQNTLDENFEGESINYTGWLDLDEKRYYFTDEYIAATGSVIIDGEEYYFDPDTAQLVISE

SEQ ID NO: 87 - protein, 2366 aa, Clostridium difficile
MSLVNRKQLEKMANVRFRTQEDEYVAILDALEEYHNMSENTVVEKYLKLKDINSLTDIYIDTYKKSGRNKALKKFKEYLVTEVLELKNNNLTPVEKNLHFVWIGGQINDTAINYINQWKDVNSDYNVNVFYDSNAFLINTLKKTIVESAINDTLESFRENLNNPRFDYNKFFRKRMEIIYDKQKNFINYYKAQREENPELIIDDIVKIYLSNEYSKEIDELNTYIEESLNKIKQNSGNDVRNFEEFKNGESFKLYEQELVERWNLAAASDILRISALKEIGGMYLDVDMLPGIQPDLFESIEKPSSVTVDFWEMTKLEAIMKYKEYIPGYTSEHFDMLDEEVQSSFESALASKSDKSEIFSSLGDMEASPLEVKIAFNSKGIINQGLISVKDSYCSNLIVKQIENRYKILNNSLNPAISEDNDFNTTTNTFIDSIMAEANADNGRFMMELGKYLRVGFFPDVKTTVNLSGPEAYAAAYQDLLMFKEGSMNIHLIEADLRNFEISKTNISQSTEQEMASLWTFDDARAKVQFEEYKRNYFEGSLGEDDNLDFSQNIVVDKEYLLEKISSLARSSERGYIHYIVQLQGDKISYEAACNLFAKTPYDSILFQKNIENSEVAYYYNPGDGEIQEIDKYRIPSIISDRPKIKLTFIGHGKDEFNTDIFAGLDVDSLSTEIETAIDLAKEDISSKSIEINLLGCNMFSYSINVEETYPGKLLLKVKDKISELMPSISQDSIIVSANQYEVRINNEGRRELLDHSGEWINKEESIIKDISSKEYISFNPKENKITVKSKNLPELSTLLQEIRNNSNLSDIELEEKVMLAECEINVISNIDTQIVEERIEEAKNLTSDSINYIKNEFKLIESISDSLYDLKQQNELDDSHFISFEDISKTEDGFSIRFINKETGESIFVETEKEIFSEYANHIEREISNIKDTIFDTVNGKLVKKVNLDAIHEVNTLNAAFFIQSLIGYSSSKESLSNLSVAMKVQVYAQLFSTGLNTITDAAKVVELVSTALDETIDLLPTLSEGLPVIATIIDGVSLGAAIKELSETSDPLLRQEIEAKIGIMAVNLTAATTAIITSSLGIASGFSILLVPLAGISAGIPSLVNNELVLRDKATKVVDYFKHISLVETEGAFTLLDDKIMIPQDDLVISEIDFNNNSIVLGKCEIWRMEGGSGHTVTNDIDHFFSSPTITYIKPHLSIYDVLEVQKEELDLSKDLMVLPNAPNRVFAWETGWTPGLRSLENEGTKLLDRIRDHYKGEFYWRYFAFIADALITTLKPRYEDTNIRINLDSNNRSFIVPIITTEHIREKLSYSFHGSGGTYALSLSQYNMGINIELSESDVWIIDVDNVVRDVTIDSDKIKKGDLIEGILSTLSIEDNKIILNHHEINFSGDVNGSNGFISLTFSILEGINAIIEVDLLSKSYKLLISGELKILMLNSNHIQQKIDYIGFNSELQKNIPYSFVDSEGKENGFINGSTKEGLFVSELPDVVLISKVYMDDSKPSFGYYSNNLKDVKVITKDNVNILTGYYLKDDIKISLSFTLQDEKTIKLNGVHLDESGVAEILKFMNKKGSTNTSDSLMSFLESVNIKSIFVNFLQSKINFILDANFIISGTTSIGQFEFICDENDNIQPYFIKFNTLETTYTLYVGNRQNMIVEPNYDLDDSGDISSTVINFSQKYLYGIDSCVNKVVISPNIYTDEINITPVYETNNNYPEVIVLDANYINEKINVNINDLSIRYVWSNDGNDFILMSTSEENKVSQVKIRFVNVFKDKTLANKLSFNFSDKQDVPVSEIISAFTPSYYEDGLIGYDLGLVSLYNEKFYINNFGMMVSGLIYINDSLYYFKPPVNNLITGFVTVGDDKYYFNPTNGGAASIGETIINDKNYYFNQSGILQTGVFSTEDGLKYFAPANTLDENLEGEAIDFTGKLIIDENIYYFEDNYRGAVEWKELDGEMYYFSPETGKAFKGLNQIGDDKYYFNSDGIMQKGFVSINDKKYYFDDSGVMKVGYIEIDGKYFYFAENGEMQIGVFNTSDGFKYFAHHNEDLGNEEGEAISYSGILNFNNKIYYFDYSFTAVVGWKDLEDGSKYYFDEDTAEAYVGLSLINDGQYYFNDDGIMQVGFVTINNKVFYFSDSGIIESGVQNIDDNYFYIDEKGIVQIGVFDTSDEYKYFAPANTVNDNIYGQAVDYSGLVRVGEDIYYFGETYTIETGWIYDMENESDKYYFNPETKKACKGINLIDDIKYYFDENGIMRTGLISFENNDYYFNENGEMQFGYINIEDKMFYFGEDGVMQIGVFNTQDGFKYFAHQNTLDENFEGESINYTGWLDLDEKRYYFTDEYIAATGSVIIDGEEYYFDPDTAQLVISE

SEQ ID NO: 88 - protein, 2366 aa, Clostridium difficile
MSLVNRKQLEKMANVRFRTQEDEYVAILDALEEYHNMSENTVVEKYLKLKDINSLTDIYIDTYKKSGRNKALKKFKEYLVTEVLELKNNNLTPVEKNLHFVWIGGQINDTAINYINQWKDVNSDYNVNVFYDSNAFLINTLKKTIVESAINDTLESFRENLNNPRFDYNKFFRKRMEIIYDKQKNFINYYKAQREENPELIIDDIVKIYLSNEYSKEIDELNTYIEESLNKIKQNSGNDVRNFEEFKNGESFKLYEQELVERWNLAAASDILRISALKEIGGMYLDVDMLPGIQPDLFESIEKPSSVTVDFWEMTKLEAIMKYKEYIPGYTSEHFDMLDEEVQSSFESALASKSDKSEIFSSLGDMEASPLEVKIAFNSKGIINQGLISVKDSYCSNLIVKQIENRYKILNNSLNPAISEDNDFNTTTNTFIDSIMAEANADNGRFMMELGKYLRVGFFPDVKTTVNLSGPEAYAAAYQDLLMFKEGSMNIHLIEADLRNFEISKTNISQSTEQEMASLWTFDDARAKVQFEEYKRNYFEGSLGEDDNLDFSQNIVVDKEYLLEKISSLARSSERGYIHYIVQLQGDKISYEAACNLFAKTPYDSILFQKNIENSEVAYYYNPGDGEIQEIDKYRIPSIISDRPKIKLTFIGHGKDEFNTDIFAGLDVDSLSTEIETAIDLAKEDISSNSIEINLLGCNMFSYSINVEETYPGKLLLKVKDKISELMPSISQDSIIVSANQYEVRINNEGRRELLDHSGEWINKEESIIKDISSKEYISFNPKENKITVKSKNLPELSTLLQEIRNNSNLSDIELEEKVMLAECEINVISNIDTQIVEERIEEAKNLTSDSINYIKNEFKLIESISDSLYDLKQQNELDDSHFISFEDISKTEDGFSIRFINKETGESIFVETEKEIFSEYANHIEREISNIKDTIFDTVNGKLVKKVNLDAIHEVNTLNAAFFIQSLIGYSSSKESLSNLSVAMKVQVYAQLFSTGLNTITDAAKVVELVSTALDETIDLLPTLSEGLPVIATIIDGVSLGAAIKELSETSDPLLRQEIEAKIGIMAVNLTAATTAIITSSLGIASGFSILLVPLAGISAGIPSLVNNELVLRDKATKVVDYFKHISLVETEGAFTLLDDKIMIPQDDLVISEIDFNNNSIVLGKCEIWRMEGGSGHTVTNDIDHFFSSPTITYIKPHLSIYDVLEVQKEELDLSKDLMVLPNAPNRVFAWETGWTPGLRSLENEGTKLLDRIRDHYKGEFYWRYFAFIADALITTLKPRYEDTNIRINLDSNNRSFIVPIITTEHIREKLSYSFHGSGGTYALSLSQYNMGINIELSESDVWIIDVDNVVRDVTIDSDKIKKGDLIEGILSTLSIEDNKIILNHHEINFSGDVNGSNGFISLTFSILEGINAIIEVDLLSKSYKLLISGELKILMLNSNHIQQKIDYIGFNSELQKNIPYSFVDSEGKENGFINGSTKEGLFVSELPDVVLISKVYMDDSKPSFGYYSNNLKDVKVITKDNVNILTGYYLKDDIKISLSFTLQDEKTIKLNGVHLDESGVAEILKFMNKKGSTNTSDSLMSFLESVNIKSIFVNFLQSKINFILDANFIISGTTSIGQFEFICDENDNIQPYFIKFNTLETTYTLYVGNRQNMIVEPNYDLDDSGDISSTVINFSQKYLYGIDSCVNKVVISPNIYTDEINITPVYETNNNYPEVIVLDANYINEKINVNINDLSIRYVWSNDGNDFILMSTSEENKVSQVKIRFVNVFKDKTLANKLSFNFSDKQDVPVSEIISAFTPSYYEDGLIGYDLGLVSLYNEKFYINNFGMMVSGLIYINDSLYYFKPPVNNLITGFVTVGDDKYYFNPTNGGAASIGETIINDKNYYFNQSGILQTGVFSTEDGLKYFAPANTLDENLEGEAIDFTGKLIIDENIYYFEDNYRGAVEWKELDGEMYYFSPETGKAFKGLNQIGDDKYYFNSDGIMQKGFVSINDKKYYFDDSGVMKVGYIEIDGKYFYFAENGEMQIGVFNTSDGFKYFAHHNEDLGNEEGEAISYSGILNFNNKIYYFDYSFTAVVGWKDLEDGSKYYFDEDTAEAYVGLSLINDGQYYFNDDGIMQVGFVTINNKVFYFSDSGIIESGVQNIDDNYFYIDEKGIVQIGVFDTSDEYKYFAPANTVNDNIYGQAVDYSGLVRVGEDIYYFGETYTIETGWIYDMENESDKYYFNPETKKACKGINLIDDIKYYFDENGIMRTGLISFENNDYYFNENGEMQFGYINIEDKMFYFGEDGVMQIGVFNTQDGFKYFAHQNTLDENFEGESINYTGWLDLDEKRYYFTDEYIAATGSVIIDGEEYYFDPDTAQLVISE

SEQ ID NO: 89 - protein, 2366 aa, Clostridium difficile
MSLVNRKQLEKMANVRFRVQEDEYVAILDALEEYHNMSENTVVEKYLKLKDINSLTDIYIDTYKKSGRNKALKKFKEYLVTEVLELKNNNLTPVEKNLHFVWIGGQINDTAINYINQWKDVNSDYNVNVFYDSNAFLINTLKKTIVESATNDTLESFRENLNDPRFDYNKFYRKRMEIIYDKQKNFINYYKTQREENPDLIIDDIVKIYLSNEYSKDIDELNSYIEESLNKVTENSGNDVRNFEEFKGGESFKLYEQELVERWNLAAASDILRISALKEVGGVYLDVDMLPGIQPDLFESIEKPSSVTVDFWEMVKLEAIMKYKEYIPGYTSEHFDMLDEEVQSSFESVLASKSDKSEIFSSLGDMEASPLEVKIAFNSKGIINQGLISVKDSYCSNLIVKQIENRYKILNNSLNPAISEDNDFNTTTNAFIDSIMAEANADNGRFMMELGKYLRVGFFPDVKTTINLSGPEAYAAAYQDLLMFKEGSMNIHLIEADLRNFEISKTNISQSTEQEMASLWSFDDARAKAQFEEYKKNYFEGSLGEDDNLDFSQNTVVDKEYLLEKISSLARSSERGYIHYIVQLQGDKISYEAACNLFAKTPYDSVLFQKNIEDSEIAYYYNPGDGEIQEIDKYKIPSIISDRPKIKLTFIGHGKDEFNTDIFAGLDVDSLSTEIETAIDLAKEDISPKSIEINLLGCNMFSYSVNVEETYPGKLLLRVKDKVSELMPSISQDSIIVSANQYEVRINSEGRRELLDHSGEWINKEESIIKDISSKEYISFNPKENKIIVKSKNLPELSTLLQEIRNNSNSSDIELEEKVMLAECEINVISNIDTQVVEGRIEEAKSLTSDSINYIKNEFKLIESISDALYDLKQQNELEESHFISFEDILETDEGFSIRFIDKETGESIFVETEKAIFSEYANHITEEISKIKGTIFDTVNGKLVKKVNLDATHEVNTLNAAFFIQSLIEYNSSKESLSNLSVAMKVQVYAQLFSTGLNTITDAAKVVELVSTALDETIDLLPTLSEGLPVIATIIDGVSLGAAIKELSETSDPLLRQEIEAKIGIMAVNLTAATTAIITSSLGIASGFSILLVPLAGISAGIPSLVNNELILRDKATKVVDYFSHISLAESEGAFTSLDDKIMMPQDDLVISEIDFNNNSITLGKCEIWRMEGGSGHTVTDDIDHFFSAPSITYREPHLSIYDVLEVQKEELDLSKDLMVLPNAPNRVFAWETGWTPGLRSLENDGTKLLDRIRDNYEGEFYWRYFAFIADALITTLKPRYEDTNIRINLDSNTRSFIVPVITTEYIREKLSYSFYGSGGTYALSLSQYNMNINIELNENDTWVIDVDNVVRDVTIESDKIKKGDLIENILSKLSIEDNKIILDNHEINFSGTLNGGNGFVSLTFSILEGINAVIEVDLLSKSYKVLISGELKTLMANSNSVQQKIDYIGLNSELQKNIPYSFMDDKGKENGFINCSTKEGLFVSELSDVVLISKVYMDNSKPLFGYCSNDLKDVKVITKDDVIILTGYYLKDDIKISLSFTIQDENTIKLNGVYLDENGVAEILKFMNKKGSTNTSDSLMSFLESMNIKSIFINSLQSNTKLILDTNFIISGTTSIGQFEFICDKDNNIQPYFIKFNTLETKYTLYVGNRQNMIVEPNYDLDDSGDISSTVINFSQKYLYGIDSCVNKVIISPNIYTDEINITPIYEANNTYPEVIVLDTNYISEKINININDLSIRYVWSNDGSDFILMSTDEENKVSQVKIRFTNVFKGNTISDKISFNFSDKQDVSINKVISTFTPSYYVEGLLNYDLGLISLYNEKFYINNFGMMVSGLVYINDSLYYFKPPIKNLITGFTTIGDDKYYFNPDNGGAASVGETIIDGKNYYFSQNGVLQTGVFSTEDGFKYFAPADTLDENLEGEAIDFTGKLTIDENVYYFGDNYRAAIEWQTLDDEVYYFSTDTGRAFKGLNQIGDDKFYFNSDGIMQKGFVNINDKTFYFDDSGVMKSGYTEIDGKYFYFAENGEMQIGVFNTADGFKYFAHHDEDLGNEEGEALSYSGILNFNNKIYYFDDSFTAVVGWKDLEDGSKYYFDEDTAEAYIGISIINDGKYYFNDSGIMQIGFVTINNEVFYFSDSGIVESGMQNIDDNYFYIDENGLVQIGVFDTSDGYKYFAPANTVNDNIYGQAVEYSGLVRVGEDVYYFGETYTIETGWIYDMENESDKYYFDPETKKAYKGINVIDDIKYYFDENGIMRTGLITFEDNHYYFNEDGIMQYGYLNIEDKTFYFSEDGIMQIGVFNTPDGFKYFAHQNTLDENFEGESINYTGWLDLDEKRYYFTDEYIAATGSVIIDGEEYYFDPDTAQLVISE

SEQ ID NO: 90 - protein, 2367 aa, Clostridium difficile
MSLVNRKQLEKMANVRFRVQEDEYVAILDALEEYHNMSENTVVEKYLKLKDINSLTDTYIDTYKKSGRNKALKKFKEYLVIEILELKNSNLTPVEKNLHFIWIGGQINDTAINYINQWKDVNSDYNVNVFYDSNAFLINTLKKTIIESASNDTLESFRENLNDPEFNHTAFFRKRMQIIYDKQQNFINYYKAQKEENPDLIIDDIVKTYLSNEYSKDIDELNAYIEESLNKVTENSGNDVRNFEEFKTGEVFNLYEQESVERWNLAGASDILRVAILKNIGGVYLDVDMLPGIHPDLFKDINKPDSVKTAVDWEEMQLEAIMKHKEYIPEYTSKHFDTLDEEVQSSFESVLASKSDKSEIFLPLGDIEVSPLEVKIAFAKGSIINQALISAKDSYCSDLLIKQIQNRYKILNDTLGPIISQGNDFNTTMNNFGESLGAIANEENISFIAKIGSYLRVGFYPEANTTITLSGPTIYAGAYKDLLTFKEMSIDTSILSSELRNFEFPKVNISQATEQEKNSLWQFNEERAKIQFEEYKKNYFEGALGEDDNLDFSQNTVTDKEYLLEKISSSTKSSEGGYVHYIVQLQGDKISYEAACNLFAKNPYDSILFQRNIEDSEVAYYYNPTDSEIQEIDKYRIPDRISDRPKIKLTFIGHGKAEFNTDIFAGLDVDSLSSEIETAIGLAKEDISPKSIEINLLGCNMFSYSVNVEETYPGKLLLRVKDKVSELMPSMSQDSIIVSANQYEVRINSEGRRELLDHSGEWINKEESIIKDISSKEYISFNPKENKIIVKSKNLPELSTLLQEIRNNSNSSDIELEEKVMLAECEINVISNIETQVVEERIEEAKSLTSDSINYIKNEFKLIESISEALCDLKQQNELEDSHFISFEDISETDEGFSIRFINKETGESIFVETEKTIFSEYANHITEEISKIKGTIFDTVNGKLVKKVNLDTTHEVNTLNAAFFIQSLIEYNSSKESLSNLSVAMKVQVYAQLFSTGLNTITDAAKVVELVSTALDETIDLLPTLSEGLPIIATIIDGVSLGAAIKELSETSDPLLRQEIEAKIGIMAVNLTTATTAIITSSLGIASGFSILLVPLAGISAGIPSLVNNELVLRDKATKVVDYFKHVSLVETEGVFTLLDDKVMMQQDDLVISEIDFNNNSIVLGKCEIWRMEGGSGHTVTDDIDHFFSAPSITYREPHLSIYDVLEVQKEELDLSKDLMVLPNAPNRVFAWETGWTPGLRSLENDGTKLLDRIRDNYEGEFYWRYFAFIADALITTLKPRYEDTNIRINLDSNTRSFIVPIITTEYIREKLSYSFYGSGGTYALPLSQYNMGINIELSESDVWIIDVDNVVRDVTIESDKIKKGDLIEGILSTLSIEENKIILNSHEINFSGEVNGSNGFVSLTFSILEGINAIIEVDLLSKSYKLLISGELKILMLNSNHIQQKIDYIGFNSELQKNIPYSFVDSEGKENGFINGSTKEGLFVSELPDVVLISKVYMDDSKPSFGYYSNNLKDVKVITKDNVNILTGYYLKDDIKISLSLTLQDEKTIKLNSVHLDESGVAEILKFMNRKGSTNTSDSLMSFLESMNIKSIFVNFLQSNIKFILDANFIISGTTSIGQFEFICDENNNIQPYFIKFNTLETNYTLYVGNRQNMIVEPNYDLDDSGDISSTVINFSQKYLYGIDSCVNKVVISPNIYTDEINITPVYETNNTYPEVIVLDANYINEKINVNINDLSIRYVWSNDGNDFILMSTSEENKVSQVKIRFVNVFKDKTLANKLSFNFSDKQDVPVSEIILSFTPSYYEDGLIGYDLGLVSLYNEKFYINNFGMMVSGLIYINDSLYYFKPPVNNLITGFVTVGDDKYYFNPINGGAASIGETIIDDKNYYFNQSGVLQTGVFSTEDGFKYFAPANTLDENLEGEAIDFTGKLIIDENIYYFEDNYRGAVEWKELDGEMHYFSPETGKAFKGLNQIGDDKYYFNSDGVMQKGFVSINDNKHYFDDSGVMKVGYTEIDGKHFYFAENGEMQIGVFNTEDGFKYFAHHNEDLGNEEGEEISYSGILNFNNKIYYFDDSFTAVVGWKDLEDGSKYYFDEDTAEAYIGLSLINDGQYYFNDDGIMQVGFVTINDKVFYFSDSGIIESGVQNIDDNYFYIDDNGIVQIGVFDTSDGYKYFAPANTVNDNIYGQAVEYSGLVRVGEDVYYFGETYTIETGWIYDMENESDKYYFVPETKKACKGINLIDDIKYYFDEKGIMRTGLISFENNNYYFNENGEIQFGYINIEDKMFYFGEDGVMQIGVFNTPDGFKYFAHQNTLDENFEGESINYTGWLGLDEKRYYFTDEYIAATGSVIIDGEEYYFDPDTAQLVISE

SEQ ID NO: 91 - protein, 2367 aa, Clostridium difficile
MSLVNRKQLEKMANVRFRVQEDEYVAILDALEEYHNMSENTVVEKYLKLKDINSLTDTYIDTYKKSGRNKALKKFKEYLVTEILELKNSNLTPVEKNLHFIWIGGQINDTAINYINQWKDVNSDYNVNVFYDSNAFLINTLKKTIIESASNDTLESFRENLNDPEFNHTAFFRKRMQIIYDKQQNFINYYKAQKEENPDLIIDDIVKTYLSNEYSKDIDELNAYIEESLNKVTENSGNDVRNFEEFKTGEVFNLYEQELVERWNLAGASDILRVAILKNIGGVYLDVDMLPGIHPDLFKDINKPDSVKTAVDWEEMQLEAIMKYKEYIPEYTSKHFDTLDEEVQSSFESVLASKSDKSEIFLPLGGIEVSPLEVKVAFAKGSIIDQALISAKDSYCSDLLIKQIQNRYKILNDTLGPIISQGNDFNTTMNNFGESLGAIANEENISFIAKIGSYLRVGFYPEANTTITLSGPTIYAGAYKDLLTFKEMSIDTSILSSELRNFEFPKVNISQATEQEKNSLWQFNEERAKIQFEEYKKNYFEGALGEDDNLDFSQNTVTDKEYLLEKISSSTKSSERGYVHYIVQLQGDKISYEAACNLFAKNPYDSILFQKNIEDSEVAYYYNPTDSEIQEIDKYRIPDRISDRPKIKLTLIGHGKAEFNTDIFAGLDVDSLSSEIETILDLAKADISPKSIEINLLGCNMFSYSVNVEETYPGKLLLRVKDKVSELMPSISQDSIIVSANQYEVRINSEGRRELLDHSGEWINKEESIIKDISSKEYISFNPKENKIIVKSKNLPELSTLLQEIRNNSNSSDIELEEKVMLAECEINVISNIETQVVEERIEEAKSLTSDSINYIKNEFKLIESISDALYDLKQQNELEESHFISFEDISKTDEGFSIRFIDKETGESIFVETEKAIFSEYANHITEEISKLKDTIFDTVNGKLVKKVTLDATHEVNTLNAAFFIQSLIGYNSSKESLSNLSVAMKVQVYAQLFSTGLNTITDAAKVVELVSTALDETIDLLPTLSEGLPVIATIIDGVSLGASIKELSETSDPLLRQEIEAKIGIMAVNLTAATTAIITSSLGIASGFSILLVPLAGISAGIPSLVNNELILRAEAKNVVDYFGHISLAESEGAFTLLDDKIMMPQDDLVISEIDFNNNSITLGKCEIWRMEGGSGHTVTDDIDHFFSAPSTTYREPYLSIYDVLDVKEEELDLSKDLMVLPNAPDRIFGWERGWTPGLRSLENDGTKLLDRIRDHYEGQFYWRFFAFIADSVITKLKPRYEDTNIRISLDSNTRSFIVPVITTEYIREKLSYSFYGSGGTYALSLSQYNMNINIELNENDTWVIDVDNVVRDVTIESDKIKKGDLIENILSKLSIEDNKIILDNHEINFSGTLNGGNGFVSLTFSILEGINAVIEVDLLSKSYKVLISGELKTLMANSNSVQQKIDYIGLNSELQKNIPYSFMDDEGKENGFINCFTKEGLFVSELSDVVLIIKVYMDNSKPPFGYYSNDLKDVKVITKDDVIIITGYYLKDDIKISLSFTIQDKNTIKLNGVYLDENGVAEILKFMNKKGSTNTSDSLMSFLESMNIKSIFIKSLKSNAKLILDTNFIISGTTFIGQFEFICDKDNNIQPYFIKFNTLETKYTLYVGNRQNMIVEPNYNLDDSGDISSTVINFSQKYLYGIDSCVNKVVISPGIYTDEINITPVHEANNTYPEVIVLDTNYISEKINININDLSIRYVWSNDGSDFILMSTDEENKVSQVKIRFTNVFKGNTISDKISFNFSDKQDISINKIISTFTPSYYVEGLLNYDLGLISLYNEKFYINNLGMMVSGLVYINDSLYYFKPPIKNLITGFTTIGDDKYYFNPDNGGPASVGETIIDGKNYYFSQNGVLQTGVFSTEDGFKYFAPADTLDENLEGEAIDFTGKLIIDENVYYFGDNYRAAIEWQTLDDEVYYFSTDTGRAFKGLNQIGDDKFYFNSDGIMQKGFVNINDKTFYFDDSGVMKSGYTEIDGRYFYFAENGEMQIGVFNTADGFKYFAHHDEDLGNEEGEALSYSGILNFNNKIYYFDDSFTAVVGWKDLEDGSKYYFDENTAEASIGISIINDGKYYFNDSGIMQIGFVTINNEVFYFSDSGIVESGMQNIDDNYFYISENGLVQIGVFDTSDGYKYFAPANTVNDNIYGQAVEYSGLVRVNEDVYSFGESYTIETGWIYDSENESDKYYFDPEAKKAYKGINVIDDIKYYFDENGIMRTGLITFEDNHYYFNEDGEMQYGYLNIEDKMFYFSEDGIMQIGVFNTPDGFKYFAHQNTLDENFEGESINYTGWLDLDEKRYYFTDEYIAATGSVIIDGEEYYFDPDTAQLVISE

SEQ ID NO: 92 - protein, 2367 aa, Clostridium difficile
MSLVNRKQLEKMANVRFRVQEDEYVAILDALEEYHNMSENTVVEKYLKLKDINSLTDTYIDTYKKSGRNKALKKFKEYLVIEILELENSNLTPVEKNLHFIWIGGQINDTAINYINQWKDVNSDYNVNVFYDSNAFLINTLKKTIIESASNDTLESFRENLNDPEFNHTAFFRKRMQIIYDKQQNFINYYKAQKEENPDLIIDDIVKTYLSNEYSKDIDELNAYIEESLNKVTENSGNDVRNFEEFKTGEVFNLYEQELVERWNLAGASDILRVAILKNIGGVYLDVDMLPGIHPDLFKDINKPDSVKTAVDWEEMQLEAIMKHKEYIPEYTSKHFDTLDEEVQSSFESVLASKSDKSEIFLPLGDIEVSPLEVKIAFAKGSIINQALISAKDSYCSDLLIKQIQNRYKILNDTLGPIISQGNDFNTTMNNFGESLGAIANEENISFIAKIGSYLRVGFYPEANTTVTLSGPTIYAGAYKDLLTFKEMSIDTSILSSELRNFEFPKVNISQATEQEKNSLWQFNEERAKIQFEEYKKNYFEGALGEDDNLDFSQNTVTDKEYLLEKISSSTKSSERGYVHYIVQLQGDKISYEAACNLFAKNPYDSILFQKNIEDSEVAYYYNPTDSEIQEIDKYRIPDRISDRPKIKLTFIGHGKAEFNTDIFAGLDVDSLSSEIETAIGLAKEDISPKSIEINLLGCNMFSYSVNVEETYPGKLLLRVKDKVSELMPSMSQDSIIVSANQYEVRINSEGRRELLDHSGEWINKEESIIKDISSKEYISFNPKENKVIVKSKNLPELSTLLQEIRNNSNSSDIELEEKVMLAECEINVISNIETQVVEERIEEAKSLTSDSINYIKNEFKLIESISDALCDLKQQNELEDSHFISFEDISETDEGFSIRFINKETGESIFVETEKTIFSEYANHITEEISKIKGTIFDTVNGKLVKKVNLDTTHEVNTLNAAFFIQSLIEYNSSKESLSNLSVAMKVQVYAQLFSTGLNTITDAARVVELVSTALDETIDLLPTLSEGLPIIATIIDGVSLGAAIKELSETSDPLLRQEIEAKIGIMAVNLTTATTAIITSSLGIASGFSILLVPLAGISAGIPSLVNNELVLRDKATKVVDYFKHVSLVETEGVFTLLDDKVMMPQDDLVISEIDFNNNSIVLGKCEIWRMEGGSGHTVTDDIDHFFSAPSITYREPHLSIYDVLEVQKEELDLSKDLMVLPNAPNRVFAWETGWTPGLRSLENDGTKLLDRIRDNYEGEFYWRYFAFIADALITTLKPRYEDTNIRINLDSNTRSFIVPIITTEYIREKLSYSFYGSGGTYALSLSQYNMGINIELSESDVWIIDVDNVVRDVTIESDKIKKGDLIEGILSTLSIEENKIILNSHEINFSGEVNGSNGFVSLTFSILEGINAIIEVDLLSKSYKLLISGELKILMLNSNHIQQKIDYIGFNSELQKNIPYSFVDSEGKENGFINGSTKEGLFVSELPDVVLISKVYMDDSKPSFGYYSNNLKDVKVITKDNVNILTGYYLKDDIKISLSLTLQDEKTIKLNSVHLDESGVAEILKFMNRKGSTNTSDSLMSFLESMNIKSIFVNFLQSNIKFILDANFIISGTTSIGQFEFICDENNNIQPYFIKFNTLETNYTLYVGNRQNMIVEPNYDLDDSGDISSTVINFSQKYLYGIDSCVNKVVISPNIYTDEINITPVYETNNTYPEVIVLDANYINEKINVNINDLSIRYVWSNDGNDFILMSTSEENKVSQVKIRFVNVFKDKTLANKLSFNFSDKQDVPVSEIILSFTPSYYEDGLIGYDLGLVSLYNEKFYINNFGMMVSGLIYINDSLYYFKPPVNNLITGFVTVGDDKYYFNPINGGAASIGETIIDDKNYYFNQSGVLQTGVFSTEDGFKYFAPANTLDENLEGEAIDFTGKLIIDENIYYFEDNYRGAVEWKELDGEMHYFSPETGKAFKGLNQIGDDKYYFNSDGVMQKGFVSINDNKHYFDDSGVMKVGYTEIDGKHFYFAENGEMQIGVFNTEDGFKYFAHHNEDLGNEEGEEISYSGILNFNNKIYYFDDSFTAVVGWKDLEDGSKYYFDEDTAEAYIGLSLINDGQYYFNDDGIMQVGFVTINDKVFYFSDSGIIESGVQNIDDNYFYIDDNGIVQIGVFDTSDGYKYFAPANTVNDNIYGQAVEYSGLVRVGEDVYYFGETYTIETGWIYDMENESDKYYFDPETKKACKGINLIDDIKYYFDEKGIMRTGLISFENNNYYFNENGEMQFGYINIEDKMFYFGEDGDMQIGVFNTPDGFKYFAHQNTLDENFEGESINYTGWLDLDEKRYYFTDEYIAATGSVIIDGEEYYFDPDTAQLVISE

SEQ ID NO: 93 - protein, 2366 aa, Clostridium difficile
MSLVNRKQLEKMANVRFRTQEDEYVAILDALEEYHNMSENTVVEKYLKLKDINSLTDIYIDTYKKSGRNKALKKFKEYLVTEVLELKNNNLTPVEKNLHFVWIGGQINDTAINYINQWKDVNSDYNVNVFYDSNAFLINTLKKTVVESAINDTLESFRENLNDPRFDYNKFFRKRMEIIYDKQKNFINYYKAQREENPELIIDDIVKTYLSNEYSKEIDELNTYIEESLNKITQNSGNDVRNFEEFKNGESFNLYEQELVERWNLAAASDILRISALKEIGGMYLDVDMLPGIQPDLFESIEKPSSVTVDFWEMTKLEAIMKYKEYIPEYTSEHFDMLDEEVQSSFESVLASKSDKSEIFSSLGDMEASPLEVKIAFNSKGIINQGLISVKDSYCSNLIVKQIENRYKILNNSLNPAISEDNDFNTTTNTFIDSIMAEANADNGRFMMELGKYLRVGFFPDVKTTINLSGPEAYAAAYQDLLMFKEGSMNIHLIEADLRNFEISKTNISQSTEQEMASLWSFDDARAKAQFEEYKRNYFEGSLGEDDNLDFSQNIVVDKEYLLEKISSLARSSERGYIHYIVQLQGDKISYEAACNLFAKTPYDSVLFQKNIEDSEIAYYYNPGDGEIQEIDKYKIPSIISDRPKIKLTFIGHGKDEFNTDIFAGFDVDSLSTEIEAAIDLAKEDISPKSIEINLLGCNMFSYSINVEETYPGKLLLKVKDKISELMPSISQDSIIVSANQYEVRINSEGRRELLDHSGEWINKEESIIKDISSKEYISFNPKENKITVKSKNLPELSTLLQEIRNNSNSSDIELEEKVMLTECEINVISNIDTQIVEERIEEAKNLTSDSINYIKDEFKLIESISDALCDLKQQNELEDSHFISFEDISETDEGFSIRFINKETGESIFVETEKTIFSEYANHITEEISKIKGTIFDTVNGKLVKKVNLDTTHEVNTLNAAFFIQSLIEYNSSKESLSNLSVAMKVQVYAQLFSTGLNTITDAAKVVELVSTALDETIDLLPTLSEGLPIIATIIDGVSLGAAIKELSETSDPLLRQEIEAKIGIMAVNLTTATTAIITSSLGIASGFSILLVPLAGISAGIPSLVNNELVLRDKATKVVDYFKHVSLVETEGVFTLLDDKIMMPQDDLVISEIDFNNNSIVLGKCEIWRMEGGSGHTVTDDIDHFFSAPSITYREPHLSIYDVLEVQKEELDLSKDLMVLPNAPNRVFAWETGWTPGLRSLENDGTKLLDRIRDNYEGEFYWRYFAFIADALITTLKPRYEDTNIRINLDSNTRSFIVPIITTEYIREKLSYSFYGSGGTYALSLSQYNMGINIELSESDVWIIDVDNVVRDVTIESDKIKKGDLIEGILSTLSIEENKIILNSHEINFSGEVNGSNGFVSLTFSILEGINAIIEVDLLSKSYKLLISGELKILMLNSNHIQQKIDYIGFNSELQKNIPYSFVDSEGKENGFINGSTKEGLFVSELPDVVLISKVYMDDSKPSFGYYSNNLKDVKVITKDNVNILTGYYLKDDIKISLSLTLQDEKTIKLNSVHLDESGVAEILKFMNRKGNTNTSDSLMSFLESMNIKSIFVNFLQSNIKFILDANFIISGTTSIGQFEFICDENDNIQPYFIKFNTLETNYTLYVGNRQNMIVEPNYDLDDSGDISSTVINFSQKYLYGIDSCVNKVVISPNIYTDEINITPVYETNNTYPEVIVLDANYINEKINVNINDLSIRYVWSNDGNDFILMSTSEENKVSQVKIRFVNVFKDKTLANKLSFNFSDKQDVPVSEIILSFTPSYYEDGLIGYDLGLVSLYNEKFYINNFGMMVSGLIYINDSLYYFKPPVNNLITGFVTVGDDKYYFNPINGGAASIGETIIDDKNYYFNQSGVLQTGVFSTEDGFKYFAPANTLDENLEGEAIDFTGKLIIDENIYYFDDNYRGAVEWKELDGEMHYFSPETGKAFKGLNQIGDYKYYFNSDGVMQKGFVSINDNKHYFDDSGVMKVGYTEIDGKHFYFAENGEMQIGVFNTEDGFKYFAHHNEDLGNEEGEEISYSGILNFNNKIYYFDDSFTAVVGWKDLEDGSKYYFDEDTAEAYIGLSLINDGQYYFNDDGIMQVGFVTINDKVFYFSDSGIIESGVQNIDDNYFYIDDNGIVQIGVFDTSDGYKYFAPANTVNDNIYGQAVEYSGLVRVGEDVYYFGETYTIETGWIYDMENESDKYYFNPETKKACKGINLIDDIKYYFDEKGIMRTGLISFENNNYYFNENGEMQFGYINIEDKMFYFGEDGVMQIGVFNTPDGFKYFAHQNTLDENFEGESINYTGWLDLDEKRYYFTDEYIAATGSVIIDGEEYYFDPDTAQLVISE

SEQ ID NO: 94 - protein, 2710 aa, Clostridium difficile
MSLISKEELIKLAYSIRPRENEYKTILTNLDEYNKLTTNNNENKYLQLKKLNESIDVFMNKYKTSSRNRALSNLKKDILKEVILIKNSNTSPVEKNLHFVWIGGEVSDIALEYIKQWADINAEYNIKLWYDSEAFLVNTLKKAIVESSTTEALQLLEEEIQNPQFDNMKFYKKRMEFIYDRQKRFINYYKSQINKPTVPTIDDIIKSHLVSEYNRDETVLESYRTNSLRKINSNHGIDIRANSLFTEQELLNIYSQELLNRGNLAAASDIVRLLALKNFGGVYLDVDMLPGIHSDLFKTISRPSSIGLDRWEMIKLEAIMKYKKYINNYTSENFDKLDQQLKDNFKLIIESKSEKSEIFSKLENLNVSDLEIKIAFALGSVINQALISKQGSYLTNLVIEQVKNRYQFLNQHLNPAIESDNNFTDTTKIFHDSLFNSATAENSMFLTKIAPYLQVGFMPEARSTISLSGPGAYASAYYDFINLQENTIEKTLKASDLIEFKFPENNLSQLTEQEINSLWSFDQASAKYQFEKYVRDYTGGSLSEDNGVDFNKNTALDKNYLLNNKIPSNNVEEAGSKNYVHYIIQLQGDDISYEATCNLFSKNPKNSIIIQRNMNESAKSYFLSDDGESILELNKYRIPERLKNKEKVKVTFIGHGKDEFNTSEFARLSVDSLSNEISSFLDTIKLDISPKNVEVNLLGCNMFSYDFNVEETYPGKLLLSIMDKITSTLPDVNKNSITIGANQYEVRINSEGRKELLAHSGKWINKEEAIMSDLSSKEYIFFDSIDNKLKAKSKNIPGLASISEDIKTLLLDASVSPDTKFILNNLKLNIESSIGDYIYYEKLEPVKNIIHNSIDDLIDEFNLLENVSDELYELKKLNNLDEKYLISFEDISKNNSTYSVRFINKSNGESVYVETEKEIFSKYSEHITKEISTIKNSIITDVNGNLLDNIQLDHTSQVNTLNAAFFIQSLIDYSSNKDVLNDLSTSVKVQLYAQLFSTGLNTIYDSIQLVNLISNAVNDTINVLPTITEGIPIVSTILDGINLGAAIKELLDEHDPLLKKELEAKVGVLAINMSLSIAATVASIVGIGAEVTIFLLPIAGISAGIPSLVNNELILHDKATSVVNYFNHLSESKKYGPLKTEDDKILVPIDDLVISEIDFNNNSIKLGTCNILAMEGGSGHTVTGNIDHFFSSPSISSHIPSLSIYSAIGIETENLDFSKKIMMLPNAPSRVFWWETGAVPGLRSLENDGTRLLDSIRDLYPGKFYWRFYAFFDYAITTLKPVYEDTNIKIKLDKDTRNFIMPTITTNEIRNKLSYSFDGAGGTYSLLLSSYPISTNINLSKDDLWIFNIDNEVREISIENGTIKKGKLIKDVLSKIDINKNKLIIGNQTIDFSGDIDNKDRYIFLTCELDDKISLIIEINLVAKSYSLLLSGDKNYLISNLSNTIEKINTLGLDSKNIAYNYTDESNNKYFGAISKTSQKSIIHYKKDSKNILEFYNDSTLEFNSKDFIAEDINVFMKDDINTITGKYYVDNNTDKSIDFSISLVSKNQVKVNGLYLNESVYSSYLDFVKNSDGHHNTSNFMNLFLDNISFWKLFGFENINFVIDKYFTLVGKTNLGYVEFICDNNKNIDIYFGEWKTSSSKSTIFSGNGRNVVVEPIYNPDTGEDISTSLDFSYEPLYGIDRYINKVLIAPDLYTSLININTNYYSNEYYPEIIVLNPNTFHKKVNINLDSSSFEYKWSTEGSDFILVRYLEESNKKILQKIRIKGILSNTQSFNKMSIDFKDIKKLSLGYIMSNFKSFNSENELDRDHLGFKIIDNKTYYYDEDSKLVKGLININNSLFYFDPIEFNLVTGWQTINGKKYYFDINTGAALTSYKIINGKHFYFNNDGVMQLGVFKGPDGFEYFAPANTQNNNIEGQAIVYQSKFLTLNGKKYYFDNNSKAVTGWRIINNEKYYFNPNNAIAAVGLQVIDNNKYYFNPDTAIISKGWQTVNGSRYYFDTDTAIAFNGYKTIDGKHFYFDSDCVVKIGVFSTSNGFEYFAPANTYNNNIEGQAIVYQSKFLTLNGKKYYFDNNSKAVTGLQTIDSKKYYFNTNTAEAATGWQTIDGKKYYFNTNTAEAATGWQTIDGKKYYFNTNTAIASTGYTIINGKHFYFNTDGIMQIGVFKGPNGFEYFAPANTDANNIEGQAILYQNEFLTLNGKKYYFGSDSKAVTGWRIINNKKYYFNPNNAIAAIHLCTINNDKYYFSYDGILQNGYITIERNNFYFDANNESKMVTGVFKGPNGFEYFAPANTHNNNIEGQAIVYQNKFLTLNGKKYYFDNDSKAVTGWQTIDGKKYYFNLNTAEAATGWQTIDGKKYYFNLNTAEAATGWQTIDGKKYYFNTNTFIASTGYTSINGKHFYFNTDGIMQIGVFKGPNGFEYFAPANTDANNIEGQAILYQNKFLTLNGKKYYFGSDSKAVTGLRTIDGKKYYFNTNTAVAVTGWQTINGKKYYFNTNTSIASTGYTIISGKHFYFNTDGIMQIGVFKGPDGFEYFAPANTDANNIEGQAIRYQNRFLYLHDNIYYFGNNSKAATGWVTIDGNRYYFEPNTAMGANGYKTIDNKNFYFRNGLPQIGVFKGSNGFEYFAPANTDANNIEGQAIRYQNRFLHLLGKIYYFGNNSKAVTGWQTINGKVYYFMPDTAMAAAGGLFEIDGVIYFFGVDGVKAPGIYG

SEQ ID NO: 95 - protein, 2710 aa, Clostridium difficile
MSLISKEELIKLAYSIRPRENEYKTILTNLDEYNKLTTNNNENKYLQLKKLNESIDVFMNKYKTSSRNRALSNLKKDILKEVILIKNSNTSPVEKNLHFVWIGGEVSDIALEYIKQWADINAEYNIKLWYDSEAFLVNTLKKAIVESSTTEALQLLEEEIQNPQFDNMKFYKKRMEFIYDRQKRFINYYKSQINKPTVPTIDDIIKSHLVSEYNRDETVLESYRTNSLRKINSNHGIDIRANSLFTEQELLNIYSQELLNRGNLAAASDIVRLLALKNFGGVYLDVDMLPGIHSDLFKTISRPSSIGLDRWEMIKLEAIMKYKKYINNYTSENFDKLDQQLKDNFKLIIESKSEKSEIFSKLENLNVSDLEIKIAFALGSVINQALISKQGSYLTNLVIEQVKNRYQFLNQHLNPAIESDNNFTDTTKIFHDSLFNSATAENSMFLTKIAPYLQVGFMPEARSTISLSGPGAYASAYYDFINLQENTIEKTLKASDLIEFKFPENNLSQLTEQEINSLWSFDQASAKYQFEKYVRDYTGGSLSEDNGVDFNKNTALDKNYLLNNKIPSNNVEEAGSKNYVHYIIQLQGDDISYEATCNLFSKNPKNSIIIQRNMNESAKSYFLSDDGESILELNKYRIPERLKNKEKVKVTFIGHGKDEFNTSEFARLSVDSLSNEISSFLDTIKLDISPKNVEVNLLGCNMFSYDFNVEETYPGKLLLSIMDKITSTLPDVNKNSITIGANQYEVRINSEGRKELLAHSGKWINKEEAIMSDLSSKEYIFFDSIDNKLKAKSKNIPGLASISEDIKTLLLDASVSPDTKFILNNLKLNIESSIGDYIYYEKLEPVKNIIHNSIDDLIDEFNLLENVSDELYELKKLNNLDEKYLISFEDISKNNSTYSVRFINKSNGESVYVETEKEIFSKYSEHITKEISTIKNSIITDVNGNLLDNIQLDHTSQVNTLNAAFFIQSLIDYSSNKDVLNDLSTSVKVQLYAQLFSTGLNTIYDSIQLVNLISNAVNDTINVLPTITEGIPIVSTILDGINLGAAIKELLDEHDPLLKKELEAKVGVLAINMSLSIAATVASIVGIGAEVTIFLLPIAGISAGIPSLVNNELILHDKATSVVNYFNHLSESKKYGPLKTEDDKILVPIDDLVISEIDFNNNSIKLGTCNILAMEGGSGHTVTGNIDHFFSSPSISSHIPSLSIYSAIGIETENLDFSKKIMMLPNAPSRVFWWETGAVPGLRSLENDGTRLLDSIRDLYPGKFYWRFYAFFDYAITTLKPVYEDTNIKIKLDKDTRNFIMPTITTNEIRNKLSYSFDGAGGTYSLLLSSYPISTNINLSKDDLWIFNIDNEVREISIENGTIKKGKLIKDVLSKIDINKNKLIIGNQTIDFSGDIDNKDRYIFLTCELDDKISLIIEINLVAKSYSLLLSGDKNYLISNLSNIIEKINTLGLDSKNIAYNYTDESNNKYFGAISKTSQKSIIHYKKDSKNILEFYNDSTLEFNSKDFIAEDINVFMKDDINTITGKYYVDNNTDKSIDFSISLVSKNQVKVNGLYLNESVYSSYLDFVKNSDGHHNTSNFMNLFLDNISFWKLFGFENINFVIDKYFTLVGKTNLGYVEFICDNNKNIDIYFGEWKTSSSKSTIFSGNGRNVVVEPIYNPDTGEDISTSLDFSYEPLYGIDRYINKVLIAPDLYTSLININTNYYSNEYYPEIIVLNPNTFHKKVNINLDSSSFEYKWSTEGSDFILVRYLEESNKKILQKIRIKGILSNTQSFNKMSIDFKDIKKLSLGYIMSNFKSFNSENELDRDHLGFKIIDNKTYYYDEDSKLVKGLININNSLFYFDPIEFNLVTGWQTINGKKYYFDINTGAALISYKIINGKHFYFNNDGVMQLGVFKGPDGFEYFAPANTQNNNIEGQAIVYQSKFLTLNGKKYYFDNDSKAVTGWRIINNEKYYFNPNNAIAAVGLQVIDNNKYYFNPDTAIISKGWQTVNGSRYYFDTDTAIAFNGYKTIDGKHFYFDSDCVVKIGVFSTSNGFEYFAPANTYNNNIEGQAIVYQSKFLTLNGKKYYFDNNSKAVTGWQTIDSKKYYFNTNTAEAATGWQTIDGKKYYFNTNTAEAATGWQTIDGKKYYFNTNTAIASTGYTIINGKHFYFNTDGIMQIGVFKGPNGFEYFAPANTDANNIEGQAILYQNEFLTLNGKKYYFGSDSKAVTGWRIINNKKYYFNPNNAIAAIHLCTINNDKYYFSYDGILQNGYITIERNNFYFDANNESKMVTGVFKGPNGFEYFAPANTHNNNIEGQAIVYQNKFLTLNGKKYYFDNDSKAVTGWQTIDGKKYYFNLNTAEAATGWQTIDGKKYYFNLNTAEAATGWQTIDGKKYYFNTNTFIASTGYTSINGKHFYFNTDGIMQIGVFKGPNGFEYFAPANTHNNNIEGQAILYQNKFLTLNGKKYYFGSDSKAVTGLRTIDGKKYYFNTNTAVAVTGWQTINGKKYYFNTNTSIASTGYTIISGKHFYFNTDGIMQIGVFKGPDGFEYFAPANTDANNIEGQAIRYQNRFLYLHDNIYYFGNNSKAATGWVTIDGNRYYFEPNTAMGANGYKTIDNKNFYFRNGLPQIGVFKGSNGFEYFAPANTDANNIEGQAIRYQNRFLHLLGKIYYFGNNSKAVTGWQTINGKVYYFMPDTAMAAAGGLFEIDGVIYFFGVDGVKAPGIYG

SEQ ID NO: 96 - protein, 2710 aa, Clostridium difficile
MSLISKEELIKLAYSIRPRENEYKTILTNLDEYNKLTTNNNENKYLQLKKLNESIDVFMNKYKNSSRNRALSNLKKDILKEVILIKNSNTSPVEKNLHFVWIGGEVSDIALEYIKQWADINAEYNVKLWYDSEAFLVNTLKKAIVESSTTEALQLLEEEIQNPQFDNMKFYKKRMEFIYDRQKRFINYYKSQINKPTVPTIDDIIKSHLVSEYNRDETLLESYRTNSLRKINSNHGIDIRANSLFTEQELLNIYSQELLNRGNLAAASDIVRLLALKNFGGVYLDVDMLPGIHSDLFKTISRPSSIGLDRWEMIKLEAIMKYKKYINNYTSENFDKLDQQLKDNFKLIIESKSEKSEIFSKLENLNVSDLEIKIAFALGSVINQALISKQGSYLTNLVIEQVKNRYQFLNQHLNPAIESDNNFTDTTKIFHDSLFNSATAENSMFLTKIAPYLQVGFMPEARSTISLSGPGAYASAYYDFINLQENTIEKTLKASDLIEFKFPENNLSQLTEQEINSLWSFDQASAKYQFEKYVRDYTGGSLSEDNGVDFNKNTALDKNYLLNNKIPSNNVEEAGSKNYVHYIIQLQGDDISYEATCNLFSKNPKNSIIIQRNMNESAKSYFLSDDGESILELNKYRIPERLKNKEKVKVTFIGHGKDEFNTSEFARLSVDSLSNEISSFLDTIKLDISPKNVEVNLLGCNMFSYDFNVEETYPGKLLLSIMDKITSTLPDVNKDSITIGANQYEVRINSEGRKELLAHSGKWINKEEAIMSDLSSKEYIFFDSIDNKLKAKSKNIPGLASISEDIKTLLLDASVSPDTKFILNNLKLNIESSIGDYIYYEKLEPVKNIIHNSIDDLIDEFNLLENVSDELYELKKLNNLDEKYLISFEDISKNNSTYSVRFINKSNGESVYVETEKEIFSKYSEHITKEISTIKNSIITDVNGNLLDNIQLDHTSQVNTLNAAFFIQSLIDYSSNKDVLNDLSTSVKVQLYAQLFSTGLNTIYDSIQLVNLISNAVNDTINVLPTITEGIPIVSTILDGINLGAAIKELLDEHDPLLKKELEAKVGVLAINMSLSIAATVASIVGIGAEVTIFLLPIAGISAGIPSLVNNELILHDKATSVVNYFNHLSESKKYGPLKTEDDKILVPIDDLVISEIDFNNNSIKLGTCNILAMEGGSGHTVTGNIDHFFSSPYISSHIPSLSVYSAIGIKTENLDFSKKIMMLPNAPSRVFWWETGAVPGLRSLENDGTKLLDSIRDLYPGKFYWRFYAFFDYAITTLKPVYEDTNTKIKLDKDTRNFIMPTITTDEIRNKLSYSFDGAGGTYSLLLSSYPISMNINLSKDDLWIFNIDNEVREISIENGTIKKGNLIEDVLSKIDINKNKLIIGNQTIDFSGDIDNKDRYIFLTCELDDKISLIIEINLVAKSYSLLLSGDKNYLISNLSNTIEKINTLGLDSKNIAYNYTDESNNKYFGAISKTSQKSIIHYKKDSKNILEFYNGSTLEFNSKDFIAEDINVFMKDDINTITGKYYVDNNTDKSIDFSISLVSKNQVKVNGLYLNESVYSSYLDFVKNSDGHHNTSNFMNLFLNNISFWKLFGFENINFVIDKYFTLVGKTNLGYVEFICDNNKNIDIYFGEWKTSSSKSTIFSGNGRNVVVEPIYNPDTGEDISTSLDFSYEPLYGIDRYINKVLIAPDLYTSLININTNYYSNEYYPEIIVLNPNTFHKKVNINLDSSSFEYKWSTEGSDFILVRYLEESNKKILQKIRIKGILSNTQSFNKMSIDFKDIKKLSLGYIMSNFKSFNSENELDRDHLGFKIIDNKTYYYDEDSKLVKGLININNSLFYFDPIESNLVTGWQTINGKKYYFDINTGAASTSYKIINGKHFYFNNNGVMQLGVFKGPDGFEYFAPANTQNNNIEGQAIVYQSKFLTLNGKKYYFDNDSKAVTGWRIINNEKYYFNPNNAIAAVGLQVIDNNKYYFNPDTAIISKGWQTVNGSRYYFDTDTAIAFNGYKTIDGKHFYFDSDCVVKIGVFSGSNGFEYFAPANTYNNNIEGQAIVYQSKFLTLNGKKYYFDNNSKAVTGWQTIDSKKYYFNTNTAEAATGWQTIDGKKYYFNTNTAEAATGWQTIDGKKYYFNTNTSIASTGYTIINGKHFYFNTDGIMQIGVFKGPNGFEYFAPANTHNNNIEGQAILYQNKFLTLNGKKYYFGSDSKAITGWQTIDGKKYYFNPNNAIAATHLCTINNDKYYFSYDGILQNGYITIERNNFYFDANNESKMVTGVFKGPNGFEYFAPANTHNNNIEGQAIVYQNKFLTLNGKKYYFDNDSKAVTGWQTIDSKKYYFNLNTAVAVTGWQTIDGEKYYFNLNTAEAATGWQTIDGKRYYFNTNTYIASTGYTIINGKHFYFNTDGIMQIGVFKGPDGFEYFAPANTHNNNIEGQAILYQNKFLTLNGKKYYFGSDSKAVTGLRTIDGKKYYFNTNTAVAVTGWQTINGKKYYFNTNTYIASTGYTIISGKHFYFNTDGIMQIGVFKGPDGFEYFAPANTDANNIEGQAIRYQNRFLYLHDNIYYFGNDSKAATGWATIDGNRYYFEPNTAMGANGYKTIDNKNFYFRNGLPQIGVFKGPNGFEYFAPANTDANNIDGQAIRYQNRFLHLLGKIYYFGNNSKAVTGWQTINSKVYYFMPDTAMAAAGGLFEIDGVIYFFGVDGVKAPGIYG

SEQ ID NO: 97 - protein, 2710 aa, Clostridium difficile
MSLISKEELIKLAYSIRPRENEYKTILTNLDEYNKLTTNNNENKYLQLKKLNESIDVFMNKYKNSSRNRALSNLKKDILKEVILIKNSNTSPVEKNLHFVWIGGEVSDIALEYIKQWADINAEYNIKLWYDSEAFLVNTLKKAIVESSTTEALQLLEEEIQNPQFDNMKFYKKRMEFIYDRQKRFINYYKSQINKPTVPTIDDIIKSHLVSEYNRDETLLESYRTNSLRKINSNHGIDIRANSLFTEQELLNIYSQELLNRGNLAAASDIVRLLALKNFGGVYLDVDMLPGIHSDLFKTIPRPSSIGLDRWEMIKLEAIMKYKKYINNYTSENFDKLDQQLKDNFKLIIESKSEKSEIFSKLENLNVSDLEIKIAFALGSVINQALISKQGSYLTNLVIEQVKNRYQFLNQHLNPAIESDNNFTDTTKIFHDSLFNSATAENSMFLTKIAPYLQVGFMPEARSTISLSGPGAYASAYYDFINLQENTIEKTLKASDLIEFKFPENNLSQLTEQEINSLWSFDQASAKYQFEKYVRDYTGGSLSEDNGVDFNKNTALDKNYLLNNKIPSNNVEEAGSKNYVHYIIQLQGDDISYEATCNLFSKNPKNSIIIQRNMNESAKSYFLSDDGESILELNKYRIPERLKNKEKVKVTFIGHGKDEFNTSEFARLSVDSLSNEISSFLDTIKLDISPKNVEVNLLGCNMFSYDFNVEETYPGKLLLSIMDKITSTLPDVNKDSITIGANQYEVRINSEGRKELLAHSGKWINKEEAIMSDLSSKEYIFFDSIDNKLKAKSKNIPGLASISEDIKTLLLDASVSPDTKFILNNLKLNIESSIGDYIYYEKLEPVKNIIHNSIDDLIDEFNLLENVSDELYELKKLNNLDEKYLISFEDISKNNSTYSVRFINKSNGESVYVETEKEIFSKYSEHITKEISTIKNSIITDVNGNLLDNIQLDHTSQVNTLNAAFFIQSLIDYSSNKDVLNDLSTSVKVQLYAQLFSTGLNTIYDSIQLVNLISNAVNDTINVLPTITEGIPIVSTILDGINLGAAIKELLDEHDPLLKKELEAKVGVLAINMSLSIAATVASIVGIGAEVTIFLLPIAGISAGIPSLVNNELILHDKATSVVNYFNHLSESKEYGPLKTEDDKILVPIDDLVISEIDFNNNSIKLGTCNILAMEGGSGHTVTGNIDHFFSSPYISSHIPSLSVYSAIGIKTENLDFSKKIMMLPNAPSRVFWWETGAVPGLRSLENNGTKLLDSIRDLYPGKFYWRFYAFFDYAITTLKPVYEDTNTKIKLDKDTRNFIMPTITTDEIRNKLSYSFDGAGGTYSLLLSSYPISMNINLSKDDLWIFNIDNEVREISIENGTIKKGNLIEDVLSKIDINKNKLIIGNQTIDFSGDIDNKDRYIFLTCELDDKISLIIEINLVAKSYSLLLSGDKNYLISNLSNTIEKINTLGLDSKNIAYNYTDESNNKYFGAISKTSQKSIIHYKKDSKNILEFYNGSTLEFNSKDFIAEDINVFMKDDINTITGKYYVDNNTDKSIDFSISLVSKNQVKVNGLYLNESVYSSYLDFVKNSDGHHNTSNFMNLFLNNISFWKLFGFENINFVIDKYFTLVGKTNLGYVEFICDNNKNIDIYFGEWKTSSSKSTIFSGNGRNVVVEPIYNPDTGEDISTSLDFSYEPLYGIDRYINKVLIAPDLYTSLININTNYYSNEYYPEIIVLNPNTFHKKVNINLDSSSFEYKWSTEGSDFILVRYLEESNKKILQKIRIKGILSNTQSFNKMSIDFKDIKKLSLGYIMSNFKSFNSENELDRDHLGFKIIDNKTYYYDEDSKLVKGLININNSLFYFDPIESNLVTGWQTINGKKYYFDINTGAASTSYKIINGKHFYFNNNGVMQLGVFKGPDGFEYFAPANTQNNNIEGQAIVYQSKFLTLNGKKYYFDNDSKAVTGWRIINNEKYYFNPNNAIAAVGLQVIDNNKYYFNPDTAIISKGWQTVNGSRYYFDTDTAIAFNGYKTIDGKHFYFDSDCVVKIGVFSGSNGFEYFAPANTYNNNIEGQAIVYQSKFLTLNGKKYYFDNNSKAVTGWQTIDSKKYYFNTNTAEAATGWQTIDGKKYYFNTNTAEAATGWQTIDGKKYYFNTNTSIASTGYTIINGKYFYFNTDGIMQIGVFKVPNGFEYFAPANTHNNNIEGQAILYQNKFLTLNGKKYYFGSDSKAITGWQTIDGKKYYFNPNNAIAATHLCTINNDKYYFSYDGILQNGYITIERNNFYFDANNESKMVTGVFKGPNGFEYFAPANTHNNNIEGQAIVYQNKFLTLNGKKYYFDNDSKAVTGWQTIDSKKYYFNLNTAVAVTGWQTIDGEKYYFNLNTAEAATGWQTIDGKRYYFNTNTYIASTGYTIINGKHFYFNTDGIMQIGVFKGPDGFEYFAPANTHNNNIEGQAILYQNKFLTLNGKKYYFGSDSKAVTGLRTIDGKKYYFNTNTAVAVTGWQTINGKKYYFNTNTYIASTGYTIISGKHFYFNTDGIMQIGVFKGPDGFEYFAPANTDANNIEGQAIRYQNRFLYLHDNIYYFGNDSKAATGWATIDGNRYYFEPNTAMGANGYKTIDNKNFYFRNGLPQIGVFKGPNGFEYFAPANTDANNIDGQAIRYQNRFLHLLGKIYYFGNNSKAVTGWQTINSKVYYFMPDTAMAAAGGLFEIDGVIYFFGVDGVKAPGIYG

SEQ ID NO: 98 - protein, 2710 aa, Clostridium difficile
MSLISKEELIKLAYSIRPRENEYKTILTNLDEYNKLTTNNNENKYLQLKKLNESIDVFMNKYKTSSRNRALSNLKKDILKEVILIKNSNTSPVEKNLHFVWIGGEVSDIALEYIKQWADINAEYNIKLWYDSEAFLVNTLKKAIVESSTTEALQLLEEEIQNPQFDNMKFYKKRMEFIYDRQKRFINYYKSQINKPTVPTIDDIIKSHLVSEYNRDETVLESYRTNSLRKINSNHGIDIRANSLFTEQELLNIYSQELLNRGNLAAASDIVRLLALKNFGGVYLDVDMLPGIHSDLFKTISRPSSIGLDRWEMIKLEAIMKYKKYINNYTSENFDKLDQQLKDNFKLIIESKSEKSEIFSKLENLNVSDLEIKIAFALGSVINQALISKQGSYLTNLVIEQVKNRYQFLNQHLNPAIESDNNFTDTTKIFHDSLFNSATAENSMFLTKIAPYLQVGFMPEARSTISLSGPGAYASAYYDFINLQENTIEKTLKASDLIEFKFPENNLSQLTEQEINSLWSFDQASAKYQFEKYVRDYTGGSLSEDNGVDFNKNTALDKNYLLNNKIPSNNVEEAGSKNYVHYIIQLQGDDISYEATCNLFSKNPKNSIIIQRNMNESAKSYFLSDDGESILELNKYRIPERLKNKEKVKVTFIGHGKDEFNTSEFARLSVDSLSNEISSFLDTIKLDISPKNVEVNLLGCNMFSYDFNVEETYPGKLLLSIMDKITSTLPDVNKNSITIGANQYEVRINSEGRKELLAHSGKWINKEEAIMSDLSSKEYIFFDSIDNKLKAKSKNIPGLASISEDIKTLLLDASVSPDTKFILNNLKLNIESSIGDYIYYEKLEPVKNIIHNSIDDLIDEFNLLENVSDELYELKKLNNLDEKYLISFEDISKNNSTYSVRFINKSNGESVYVETEKEIFSKYSEHITKEISTIKNSIITDVNGNLLDNIQLDHTSQVNTLNAAFFIQSLIDYSSNKDVLNDLSTSVKVQLYAQLFSTGLNTIYDSIQLVNLISNAVNDTINVLPTITEGIPIVSTILDGINLGAAIKELLDEHDPLLKKELEAKVGVLAINMSLSIAATVASIVGIGAEVTIFLLPIAGISAGIPSLVNNELILHDKATSVVNYFNHLSESKKYGPLKTEDDKILVPIDDLVISEIDFNNNSIKLGTCNILAMEGGSGHTVTGNIDHFFSSPSISSHIPSLSIYSAIGIETENLDFSKKIMMLPNAPSRVFWWETGAVPGLRSLENDGTRLLDSIRDLYPGKFYWRFYAFFDYAITTLKPVYEDTNIKIKLDKDTRNFIMPTITTNEIRNKLSYSFDGAGGTYSLLLSSYPISTNINLSKDDLWIFNIDNEVREISIENGTIKKGKLIKDVLSKIDINKNKLIIGNQTIDFSGDIDNKDRYIFLTCELDDKISLIIEINLVAKSYSLLLSGDKNYLISNLSNTIEKINTLGLDSKNIAYNYTDESNNKYFGAISKTSQKSIIHYKKDSKNILEFYNDSTLEFNSKDFIAEDINVFMKDDVNTITGKYYVDNNTDKSIDFSISLVSKNQVKVNGLYLNESVYSSYLDFVKNSDGHHNTSNFMNLFLDNISFWKLFGFENINFVIDKYFTLVGKTNLGYVEFICDNNKNIDIYFGEWKTSSSKSTIFSGNGRNVVVEPIYNPDTGEDISTSLDFSYEPLYGIDRYINKVLIAPDLYTSLININTNYYSNEYYPEIIVLNPNTFHKKVNINLDSSSFEYKWSTEGSDFILVRYLEESNKKILQKIRIKGILSNTQSFNKMSIDFKDIKKLSLGYIMSNFKSFNSENELDRDHLGFKIIDNKTYYYDEDSKLVKGLININNSLFYFDPIEFNLVTGWQTINGKKYYFDINTGAALTSYKIINGKHFYFNNDGVMQLGVFKGPDGFEYFAPANTQNNNIEGQAIVYQSKFLTLNGKKYYFDNNSKAVTGWRIINNEKYYFNPNNAIAAVGLQVIDNNKYYFNPDTAIISKGWQTVNGSRYYFDTDTAIAFNGYKTIDGKHFYFDSDCVVKIGVFSTSNGFEYFAPANTYNNNIEGQAIVYQSKFLTLNGKKYYFDNNSKAVTGWQTIDSKKYYFNTNTAEAATGWQTIDGKKYYFNTNTAEAATGWQTIDGKKYYFNTNTAIASTGYTIINGKHFYFNTDGIMQIGVFKGPNGFEYFAPANTDANNIEGQAILYQNEFLTLNGKKYYFGSDSKAVTGWRIINNKKYYFNPNNAIAAIHLCTINNDKYYFSYDGILQNGYITIERNNFYFDANNESKMVTGVFKGPNGFEYFAPANTHNNNIEGQAIVYQNKFLTLNGKKYYFDNDSKAVTGWQTIDGKKYYFNLNTAEAATGWQTIDGKKYYFNLNTAEAATGWQTIDGKKYYFNTNTFIASTGYTSINGKHFYFNTDGIMQIGVFKGPNGFEYFAPANTDANNIEGQAILYQNKFLTLNGKKYYFGSDSKAVTGLRTIDGKKYYFNTNTAVAVTGWQTINGKKYYFNTNTSIASTGYTIISGKHFYFNTDGIMQIGVFKGPDGFEYFAPANTDANNIEGQAIRYQNRFLYLHDNIYYFGNNSKAATGWVTIDGNRYYFEPNTAMGANGYKTIDNKNFYFRNGLPQIGVFKGSNGFEYFAPANTDANNIEGQAIRYQNRFLHLLGKIYYFGNNSKAVTGWQTINGKVYYFMPDTAMAAAGGLFEIDGVIYFFGVDGVKAPGIYG

SEQ ID NO: 99 - protein, 2710 aa, Clostridium difficile; identical to SEQ ID NO: 97

SEQ ID NO: 100 - protein, 2710 aa, Clostridium difficile; identical to SEQ ID NO: 97

SEQ ID NO: 101 - protein, 2710 aa, Clostridium difficile
MSLISKEELIKLAYSIRPRENEYKTILTNLDEYNKLTTNNNENKYLQLKKLNESIDVFMNKYKNSSRNRALSNLKKDILKEVILIKNSNTSPVEKNLHFVWIGGEVSDIALEYIKQWADINAEYNIKLWYDSEAFLVNTLKKAIVESSTTEALQLLEEEIQNPQFDNMKFYKKRMEFIYDRQKRFINYYKSQINKPTVPTIDDIIKSHLVSEYNRDETLLESYRTNSLRKINSNHGIDIRANSLFTEQELLNIYSQELLNRGNLAAASDIVRLLALKNFGGVYLDVDMLPGIHSDLFKTISRPSSIGLDRWEMIKLEAIMKYKKYINNYTSENFDKLDQQLKDNFKLIIESKSEKSEIFSKLENLNVSDLEIKIAFALGSVINQALISKQGSYLTNLVIEQVKNRYQFLNQHLNPAIESDNNFTDTTKIFHDSLFNSATAENSMFLTKIAPYLQVGFMPEARSTISLSGPGAYASAYYDFINLQENTIEKTLKASDLIEFKFPENNLSQLTEQEINSLWSFDQASAKYQFEKYVRDYTGGSLSEDNGVDFNKNTALDKNYLLNNKIPSNNVEEAGSKNYVHYIIQLQGDDISYEATCNLFSKNPKNSIIIQRNMNESAKSYFLSDDGESILELNKYRIPERLKNKEKVKVTFIGHGKDEFNTSEFARLSVDSLSNEISSFLDTIKLDISPKNVEVNLLGCNMFSYDFNVEETYPGKLLLSIMDKITSTLPDVNKDSITIGANQYEVRINSEGRKELLAHSGKWINKEEAIMSDLSSKEYIFFDSIDNKLKAKSKNIPGLASISEDIKTLLLDASVSPDTKFILNNLKLNIESSIGDYIYYEKLEPVKNIIHNSIDDLIDEFNLLENVSDELYELKKLNNLDEKYLISFEDISKNNSTYSVRFINKSNGESVYVETEKEIFSKYSEHITKEISTIKDSIITDVNGNLLDNIQLDHTSQVNTLNAAFFIQSLIDYSSNKDVLNDLSTSVKVQLYAQLFSTGLNTIYDSIQLVNLISNAVNDTINVLPTITEGIPIVSTILDGINLGAAIKELLDEHDPLLKKELEAKVGVLAINMSLSIAATVASIVGIGAEVTIFLLPIAGISAGIPSLVNNELILHDKATSVVNYFNHLSESKKYGPLKTEDDKILVPIDDLVISEIDFNNNSIKLGTCNILAMEGGSGHTVTGNIDHFFSSPYISSHIPSLSVYSAIGIKTENLDFSKKIMMLPNAPSRVFWWETGAVPGLRSLENDGTKLLDSIRDLYPGKFYWRFYAFFDYAITTLKPVYEDTNIKIKLDKDTRNFIMPTITTDEIRNKLSYSFDGAGGTYSLLLSSYPISMNINLSKDDLWIFNIDNEVREISIENGTIKKGNLIEDVLSKIDINKNKLIIGNQTIDFSGDIDNKDRYIFLTCELDDKISLIIEINLVAKSYSLLLSGDKNYLISNLSNTIEKINTLGLDSKNIAYNYTDESNNKYFGVISKTSQKSIIHYKKDSKNILEFYNGSTLEFNSKDFIAEDINVFMKDDINTITGKYYVDNNTDKSIDFSISLVSKNQVKVNGLYLNESVYSSYLDFVKNSDGHHNTSNFMNLFLNNISFWKLFGFENINFVIDKYFTLVGKTNLGYVEFICDNNKNIDIYFGEWKTSSSKSTIFSGNGRNVVVEPIYNPDTGEDISTSLDFSYEPLYGIDRYINKVLIAPDLYTSLININTNYYSNEYYPEIIVLNPNTFHKKVNINLDSSSFEYKWSTEGSDFILVRYLEESNKKILQKIRIKGILSNTQSFNKMSIDFKDIKKLSLGYIMSNFKSFNSENELDRDHLGFKIIDNKTYYYDEDSKLVKGLININNSLFYFDPIESNLVTGWQTINGKKYYFDINTGAASTSYKIINGKHFYFNNNGVMQLGVFKGPDGFEYFAPANTQNNNIEGQAIVYQSKFLTLNGKKYYFDNDSKAVSGWRIINNEKYYFNPNNAIAAVGLQVIDNNKYYFNPDTAIISKGWQTVNGSRYYFDTDTAIAFNGYKTIDGKHFYFDSDCVVKIGVFSGSNGFEYFAPANTYNNNIEGQAIVYQSKFLTLNGKKYYFDNNSKAVTGWQTIDSKKYYFNTNTAEAATGWQTIDGKKYYFNTNTAEAATGWQTIDGKKYYFNTNTSIASTGYTIINGKHFYFNTDGIMQIGVFKGPNGFEYFAPANTHNNNIEGQAILYQNKFLTLNGKKYYFGSDSKAITGWQTIDGKKYYFNPNNAIAATHLCTINNDKYYFSYDGILQNGYITIERNNFYFDANNESKMVTGVFKGPNGFEYFAPANTHNNNIEGQAIVYQNKFLTLNGKKYYFDNDSKAVTGWQTIDSKKYYFNLNTAVAVTGWQTIDGEKYYFNLNTAEAATGWQTIDGKRYYFNTNTYIASTGYTIINGKHFYFNTDGIMQIGVFKGPDGFEYFAPANTHNNNIEGQAILYQNKFLTLNGKKYYFGSDSKAVTGLRTIDGKKYYFNTNTAVAVTGWQTINGKKYYFNTNTSIASTGYTIISGKHFYFNTDGIMQIGVFKGPDGFEYFAPANTDANNIEGQAIRYQNRFLYLHDNIYYFGNDSKAATGWATIDGNRYYFEPNTAMGANGYKTIDNKNFYFRNGLPQIGVFKGPNGFEYFAPANTDANNIDGQAIRYQNRFLHLLGKIYYFGNNSKAVTGWQTINSKVYYFMPDTAMAAAGGLFEIDGVIYFFGVDGVKAPGIYG

SEQ ID NO: 102 - protein, 2710 aa, Clostridium difficile
MSLISKEELIKLAYSIRPRENEYKTILTNLDEYNKLTTNNNENKYLQLKKLNESIDVFMNKYKNSSRNRALSNLKKDILKEVILIKNSNTSPVEKNLHFVWIGGEVSDIALEYIKQWADINAEYNIKLWYDSEAFLVNTLKKAIVESSTTEALQLLEEEIQNPQFDNMKFYKKRMEFIYDRQKRFVNYYKSQINKPTVPTIDDIIKSHLVSEYNRDETLLESYRTNSLRKINSNHGIDIRANSLFTEQELLNIYSQELLNRGNLAAASDIVRLLALKNFGGVYLDVDMLPGIHSDLFKTISRPSSIGLDRWEMIKLEAIMKYKKYINNYTSENFDKLDQQLKDNFKLIIESKSEKSEIFSKLENLNVSDLEIKIAFALGSVINQALISKQGSYLTNLVIEQVKNRYQFLNQHLNPAIESDNNFTDTTKIFHDSLFNSATAENSMFLTKIAPYLQVGFMPEARSTISLSGPGAYASAYYDFINLQENTIEKTLKASDLIEFKFPENNLSQLTEQEINSLWSFDQASAKYQFEKYVRDYTGGSLSEDNEVDFNKNTALDKNYLLNNKIPSNNVEEAGSKNYVHYIIQLQGDDISYEATCNLFSKNPKNSIIIQRNMNESAKSYFLSDDGESILELNKYRIPERLKNKEKVKVTFIGHGKDEFNTSEFARLSVDSLSNEISSFLDTIKLDISPKNVEVNLLGCNMFSYDFNVEETYPGKLLLSIMDKITSTLPDVNKDSITIGANQYEVRINSEGRKELLAHSGKWINKEEAIMSDLSSKEYIFFDSIDNKLKAKSKNIPGLASISEDIKTLLLDTSVSPDTKFILNNLKLNIESSVGDYIYYEKLEPVKNIIHNSIDDLIDEFNLLENVSDELYELKKLNNLDEKYLISFEDISKNNSTYSVRFINKSNGESVYVETEKEIFSKYSEHITKEISTIKNSIITDVNGNLLDNIQLDHTSQVNTLNAAFFIQSLIDYSSNKDVLNDLSTSVKVQLYAQLFSTGLNTIYDSIQLVNLISNAVNDTINVLPTITEGIPIVSTILDGINLGAAIKELLDEHDPLLKKELEAKVGVLAINMSLSIAATVASIVGIGAEVTIFLLPIAGISAGIPSLVNNELILHDKATSVVNYFNHLSESKEYGPLKTEDDKILVPIDDLVISEIDFNNNAIKLGTCNILAMEGGSGHTVTGNIDHFFSSPSISSHIPSLSIYSAIGIKTENLDFSKKIMMLPNAPSRVFWWETGAVPGLRSLENNGTKLLDSIRDLYPGKFYWRFYAFFDYAITTLKPVYEDTNIKIKLDKDTRNFIMPTITTNEIRNKLSYSFDGAGGTYSLLLSSYPISTNINLSKDDLWIFNIDNEVREISIENGTIKKGKLIKDVLSKIDINKNKLIIGNQTIDFSGDIDNKDRYIFLTCELDDKISLIIEINLVAKSYSLLLSGDKNYLISNLSNTIEKINTLGLDSKNIAYNYTDESNNKYFGAISKTSQKSIIHYKKDSKNILEFYNGSTLEFNSKDFIAEDINVFMKDDINTITGKYYVDNNTDKSIDFSISLVSKNQAKVNGLYLNESVYSSYLDFVKNADGHHNTSNFMNLFLDNISFWKLFGFENINFVVDKYFTLVGKTNLGYVEFICDNNKNIDIYFGEWKTSSSKSTIFSGNGRNVVVEPIYNPDTGEDISTSLDFSYEPLYGIDRYINKVLIAPDLYTSLININTNYYSNEYYPEIIVLNPNTFHKKVNINLDSSSFEYKWSTEGSDFILVRYLEESNKKILQKIRIKGILSNTQSFNKKSIDFKDIKKLSLVYIMSNFKSFNSENELDRDHLGFKIIDNKTYYYDEASKLVKGLININNSLFYFDPIESNLVTGWQTINGKKYYFDINTGAALTSYKIINGKHFYFNNNGVMQLGVFKGPDGFEYFAPANTQNNNIEGQAIVYQSKFLTLNGKKYYFDNDSKAVTGWRIINNEKYYFNPNNAIAAVGLQVIDNNKYYFNPDTAIISKGWQTVNGSRYYFDTDTAIAFNGYKTIDGKHFYFDSDCVVKIGVFSGSNGFEYFAPANTYNNNIEGQAIVYQSKFLTLNGEKYYFDNNSKAVTGWQTIDSKKYYFNTNTAEAATGWQTIDGKKYYFNTNTAEVATGWQTIDGKKYYFNTNTSIASTGYTIINGKHFYFNTDGIMQIGVFKGPDGFEYFAPANTDANNIEGQAILYQNKFLTLNDKKYYFASDSKAVTGWRIINNKKYYFNPNNAIAATHLYTINNDKYYFSYDGILQNGYITIERNNFYFDANNESKMVTGVFKGPNGFEYFAPANTHNNNIEGQAIVYQNKFLTLNGKKYYFDNDSKAVTGWQTIDGKKYYFNLNTAVAVTGWQTIDGKKYYFNTNTAEAATGWQTIDGKKYYFNTNTSIASTGYTIINGKHFYFNTDGIMQIGVFKGPDGFEYFAPANTDANNIEGQAILYQNKFLTLNGKKYYFASDSKAVTGLRTIDGKKYYFNTNTAEAATGWQTIDGKKYYFNTNTSIASTGYTIINDKHFYFNTDGIMQIGVFKGPDGFEYFAPANTDANNIEGQAIRYQNRFLYLHDNIYYFGNNSKAATGWVTIDGRRYYFEPNTAIGANGYKIIDNKNFYFRNGLPQIGVFKGPNGFEYFAPANTDANNIDGQAIRYQNRFLHLLGNIYYFGNNSKAVTGWQTINGNMYYFMPDTAMAAAGGLFEIDGVIYFFGVDGVKAPGIYG

What is claimed is:

1. A recombinant binary toxin protein A (CDTa) protein which comprises a set of mutations selected from the group consisting of:
   (a) S345F, E385Q and E387Q;
   (b) R302A, E385A, and E387D;
   (c) C2A, S345F, E385Q and E387Q;
   (d) R302A, S345F, E385Q and E387Q;
   (e) Y67A, Y69A, and R255A;
   (f) R359A, Y67A, and Q307E;
   (g) Y258A, F356A, S345F; and
   (h) N342A, Y253A and Y382A.

2. The CDTa protein of claim 1, wherein the protein comprises a sequence of amino acids as set forth in SEQ ID NO:40, SEQ ID NO:42, or SEQ ID NO:67.

3. An immunogenic composition comprising the CDTa protein of claim 1 and a binary toxin protein B (CDTb) from *C. difficile* and a pharmaceutically acceptable carrier.

4. The immunogenic composition of claim 3, further comprising an adjuvant.

5. The immunogenic composition of claim 3, further comprising a recombinant TcdA protein and a recombinant TcdB protein.

6. The immunogenic composition of claim 5, wherein the TcdA protein comprises the mutations W101, D287A, E514Q, W519A, and C700A; wherein the TcdB protein comprises the mutations W102A, D288A, E515Q, W520A and C698A; wherein the CDTa protein lacks a signal peptide and wherein the CDTa protein comprises the mutations C2A, S345F, E385Q, and E387Q; and wherein the CDTb protein lacks a signal peptide.

7. A method of treating *C. difficile*-associated disease comprising administering to a patient an effective amount of the immunogenic composition of claim 5.

* * * * *